United States Patent 11,931,406 (FLAVIVIRUS VACCINE) - sequence listing, part 20

SEQ ID NO: 9196 - RNA, 9876 nt, Artificial Sequence
  derived and/or modified CDS sequence (opt1) from DENV-2__GU131975__SS-prME
accgcgggcgugaucgucaugcugauccccaccgugauggccuuccaccucaccacccggaacggggagccccacaugaucgugggccggcaggagaagggcaagagccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacuccaccagcaccuggaucaccuacgggaccugcuccaccaccggcgagcaccggcgcgagaagcggagcguggcccuggugccccacgucgggaugggccucgagacccgcaccgagaccuggauguccagcgagggggccuggaagcacgugcagcggaucgagaccuggauccugcgccacccgggcuucaccaucauggccgccauccuggcguacaccaucgggaccacccacuuccagcgggcccucaucuucauccugcugacggccguggcccccuccaugaccaugcgcugcaucggcaucagcaaccgggacuucgucgagggcguguccgggggcagcuggguggacaucguccucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcaugguggaccggggcugggggaacggcugcgggcuguucggcaagggcgggaucgucacgugcgccauguucacgugcaagaagaacauggagggcaagguggugcagcccgagaaccuggaguacaccaucgucaucacgccccacuccggggaggagcacgcggugggcaacgacacggggaagcacggcaaggagaucaagaucaccccgcagagcuccaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacccuggugacguucaagaacccccacgccaagaagcaggacgucgugguccucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgugauccgcguccaguacgagggcgacggcagccccugcaagauccccuucgagaucacggaccuggagaagcggcacgugcucgggcgccugaucaccgugaacccgaucgucaccgagaaggacucccccgugaacaucgaggccgagccgcccuucggcgacagcuacaucaucaucgggguggagccgggccagcugaagcucaacugguucaagaagggguccagcaucggccagauguucgagaccacgaugcgcggcgcgaagcggauggccauccugggggacaccgccugggacuucggcucccucggcggggucuucaccagcaucgggaaggcccuccaccagguguucggggccaucuacggcgcggccuucuccggggugagcuggaccaugaagauccugaucggcgucaucaucacguggaucgggaugaacucccgcagcaccucccugagcgugucccuggugcucgucggcguggugauccuguaccugggggccaugguccaggccgacagcggcugcgugguguccuggaagaacaaggagcucaagugcggcagcgggaucuucaucaccgacaacguccacaccuggacggagcaguacaaguuccagcccgagagccccuccaagcuggcgagcgccauccagaaggcccacgaggagggcaucugcgggauccgguccgugacccgccuggagaaccucauguggaagcagaucacccccgagcugaaccacauccugagcgagaacgaggugaagcucaccaucaugacgggcgacaucaaggggaucaugcaggccggcaagcggucccugcgcccgcagcccaccgagcugaaguacagcuggaagaccuggggcaaggccaagaugcucuccaccgagagccacaaccagacguuccugaucgacgggcccgagaccgcggagugcccgaacaccaaccgggccuggaacucccuggaggucgaggacuacggcuucgggguguucaccacgaacaucuggcucaagcugcgcgagaagcaggacguguucugcgacagcaagcugauguccgccgccaucaaggacaaccgggccguccacgcggacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagaccgccgggcccuggcaccucggcaagcuggagauggacuucgaccugugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcaucggcaccaagcacgccauccuccugguggcggccuccuucgugacccugaucacggggaacaugagcuuccgggaccucggccgcgucauggugauggugggggccaccaugaccgacgacaucggcaugggcgucaccuaccuggcccugcucgccgcguucaaggugcgccccacguucgccgccgggcugcugcuccggaagcugaccuccaaggagcugaugauggccaccaucggcaucgcccuccugagccaguccaccauccccgagagcauccuggagcucacggacgcgcuggcccuggggaugauggugcucaagaucguccgcaacauggagaaguaccagcuggccgugaccaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugacgaucaagggccucaaccccaccgccaucuuccugaccacccugucccggacgagcaagaagcgcuccuggccgcucaacgaggccgugauggccgucggcauggugagcauccuggccagcucccugcucaagaacgacauccccaugaccgggccccugguggcgggcgggcugcucaccgucugcuacgugcugaccggccggagcgccgaccuggagcucgagcgcgccgccgacgugaagugggaggaccaggccgagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucacggcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagacgaacaccggcaccaucggggccgugagccucgacuucucccccggcaccagcggcucccccaucgucgaccggaaggggaagguggugggccuguacgggaacggcgucgugacgcgcagcggcgccuacgugagcgccaucgcgcagaccgagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacgcugauccucgccccgacccgcgugguggcggccgagauggaggaggcccugcggggccugcccauccgcuaccagacccccgccaucaagaccgagcacacggggcgggagaucgucgaccucaugugccacgccaccuucaccaugcgccugcugagccccgugcgggugccgaacuacaaccucaucaucauggacgaggcgcacuucaccgaccccgccuccaucgccgcccgcggcuacaucagcacgcgggucgagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagacggugugguucgucccguccaucaaggccgggaacgacaucgcggccugccugcggaagaacggcaagaaggugauccagcugagccgcaagaccuucgacuccgaguacgugaagacccgggccaacgacugggacuucgucgugaccacggacaucagcgagaugggcgccaacuucaaggccgagcgcgugaucgacccccggcgcugcaugaagcccgucauccucaccgacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagacguucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccgugcugcacaccgccgaggccgggggccgcgccuacaaccacgcccucagcgagcugcccgagacccuggagacgcuccugcugcucacccugcuggccaccgucaccgggggcaucuuccucuuccugauguccggcaaggggaucggcaagaugacgcuggggaugugcugcaucaucaccgccagcauccuccugugguacgcgcagauccagccgcacuggaucgccgccagcaucauccuggaguucuuccucaucgugcugcugauccccgagcccgagaagcagcggacgccccaggacaaccagcucaccuacgucgugaucgccauccugaccguggucgccgcgacgauggccaacgagaugggcuuccuggagaagaccaagaaggaccucgggcugggcuccaucaccacccaggagagcgaguccaacauccuggacaucgaccuccgcccggccagcgccuggacgcuguacgccguggcgaccaccuucgugacccccaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacgcgcgaggcccagaagcgggccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucaccccggagggcaaggugguggaccucggcugcgggcgcggcggguggagcuacuacugcggcgggcugaaggacguccgggaggugaagggccugaccaagggcgggcccggccacgaggagcccauccccaugagcacguacggguggaaccucgugcgccugcaguccggcaucgacgucuucuucaccccgcccgagaagugcgacacccugcucugcgacaucggggagagcucccccaaccccaccaucgaggccggccggacgcugcgcgugcugaaccucguggagaacuggcugaacaacaacacccaguucugcaucaagguccugaacccguacaugcccagcgugaucgagaagauggagacccuccagcggaaguacggcggggcccuggugcgcaacccccugucccggaacagcacccacgagauguacugggucuccaacgcgaccggcaacaucgugagcuccgugaacaugaucagccgcaugcugaucaaccgguucacgaugaagcacaagaaggccaccuacgagccggacgucgaccucggguccggcacccgcaacaucgggaucgagagcgagauccccaaccuggacaucaucggcaagcggaucgagaagaucaagcaggagcacgagaccuccuggcacuacgaccaggaccaccccuacaagacgugggccuaccacggcagcuacgagaccaagcagaccggguccgccagcuccauggugaacggcgugguccgccugcucaccaagcccugggacguggugccgauggucacgcagauggccaugaccgacaccacccccuucgggcagcagcgcguguucaaggagaagguggacacgcggacccaggagcccaaggagggcaccaagaagcugaugaagaucaccgcggaguggcuguggaaggagcucggcaagaagaagacgccccgcaugugcacccgggaggaguucacccgcaagguccggagcaacgccgcccugggggccaucuucaccgacgagaacaaguggaaguccgcccgcgaggcgguggaggacggccgguucugggagcugguggaccgcgagcggagccuccaccuggaggggaagugcgagacgugcgucuacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggggaacagccuguccggcguggagggggagggccugcaccgccucggcuacauccugcgggacguggggaagaaggagggcggggccauguacgccgacgacaccgccggcugggacacccgcaucacccuggaggaccucaagaacgaggagauggucacgaaccacaugaagggggagcacaagaagcuggccgaggcgaucuucaagcugaccuaccagaacaaggugguccgggugcagcgcccgacgccccggggcaccgugauggacaucaucagccgccgggaccagcgcggcuccgggcaggucggcacguacgggcucaacaccuucaccaacauggaggcccagcugauccgccagauggagggcgagggcaucuucaagaacauccagcaccugaccgccacggaggagaucgccgugcagaacuggcucgcccggguggggcgcgagcggcugagccgcauggcgaucuccggcgacgacugcgucgugaagcccaucgacgaccgguucgccagcgcccugaccgcccucaacgacauggggaaggugcgcaaggacauccagcagugggagcccucccggggcuggaacgacuggacccaggucccguucugcagccaccacuuccacgagcuggugaugaaggacgggcgcgugcuggucgugcccugccggaaccaggacgagcucaucggccgcgcccggaucucccagggcgcgggguggagccugaaggagaccgccugccugggcaaguccuacgcccagauguggacgcucauguacuuccaccgccgggaccugcgccuggccgccaacgcgaucugcagcgccgugcccucccacuggguccccaccagccggaccaccugguccauccacgccaagcacgaguggaugaccacggaggacaugcucgccguguggaaccgcguguggauccaggagaacccguggauggaggacaagacccccgucgagagcugggaggaggugcccuaccuggggaagcgggaggaccaguggugcggcagccugaucgggcucaccucccgcgcgaccugggccaagaacauccagacggccaucaaccaggugcggagccugaucggcaacgaggaguacaccgacuacaugcccuccaugaagcgcuuccgcaaggaggaggaggaggccggcguccugugguga

SEQ ID NO: 9197 - RNA, 9876 nt, Artificial Sequence
  derived and/or modified CDS sequence (opt1) from DENV-2__JN819422__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagaaggcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugccccacgcagggcgagcccagccugaacgaggagcaggacaagcgguucaucugcaagcacuccaugguggaccgcggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgggugauggugauggucggggccaccaugacggacgacaucggcaugggcgugaccuaccuggcccugcucgccgcguucaaggugcgccccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcggacccugauccucgccccgacgcgcgugguggcggccgagauggaggaggcccugcgcggccugcccauccgguaccagacccccgccaucaagacccagcacaccgggcgcgagaucgucgaccucaugugccacgccacguucaccaugcggcugcugagccccgugcgcgugccgaacuacaaccucaucaucauggacgaggcgcacuucaccgaccccgccuccaucgccgcccggggcuacaucagcacccgcgucgagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccccgccggugcaugaagcccgucauccucacggacggggaggagcgcgugauccuggcgggccccaugccggugacccacuccagcgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacaucgagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaagggggugggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucaccuacguggugaucgccauccugaccgucguggccgcgaccauggccaacgagaugggcuuccuggagaagacgaagaaggaccucgggcugggcagcaucaccacccaggagagcgaguccaacauccuggacaucgaccuccggccggccagcgccuggacccuguacgccguggcgacgaccuucgucacccccaugcugcgccacuccaucgagaacagcuccgugaacgugagccucaccgccaucgccaaccaggccacgguccugaugggccuggggaagggcuggccccucuccaagauggacaucggggugccccugcuggcgaucggcugcuacagccaggugaacccgaucacccucaccgccgcccugcugcuccuggucgcccacuacgccaucaucgggcccggccugcaggcgaaggccacccgggaggcccagaagcgcgccgccgcgggcaucaugaagaaccccacgguggacgggaucaccgugaucgaccucgagcccaucccguacgaccccaaguucgagaagcagcugggccaggucaugcugcucauccugugcgugacccaggugcugaugaugcggaccacgugggcccucugcgaggcccugacccuggccaccgggcccaucuccacccucugggagggcaaccccgggcgcuucuggaacacgaccaucgccgucagcauggcgaacaucuuccggggcuccuaccuggccggcgccgggcuccuguucagcaucaugaagaacaccaccaacacgcgccgcggcaccgggaacaucggcgagacccugggcgagaaguggaagucccggcugaacgcccucggcaagagcgaguuccagguguacaagaaguccggcauccaggagguggaccgcacccuggcgaaggaggggaucaagcggggcgagacggaccaccacgccgucagccgcggguccgccaagcugcggugguucguggagcgcaacauggugaccccggagggcaaggucguggaccucggcugcgggcggggcggguggagcuacuacugcggcgggcugaagaacgugcgcgaggucaagggccugaccaagggcgggcccggccacgaggagcccauccccauguccaccuacggguggaaccucgugcggcugcagagcggcguggacgucuucuucacgccgcccgagaagugcgacacccugcucugcgacaucggggagagcucccccaaccccaccaucgaggccggccgcacccugcgggugcugaaccucguggagaacuggcugaacaacaacacccaguucugcaucaagguccugaacccguacaugcccagcgugaucgagaagauggaggcccuccagcgcaaguacggcggggcgcuggugcggaacccccugucccgcaacagcacgcacgagauguacugggucuccaacgccaccggcaacaucgugagcuccgugaacaugaucagccggaugcugaucaaccgcuucaccaugaagcacaagaaggccaccuacgagccggacgucgaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcucaccaagcccugggacguggugccgauggucacccagauggcgaugaccgacacgacccccuucgggcagcagcgcguguucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaagguccgcagcaacgccgcccugggggccaucuucaccgacgagaacaaguggaaguccgcgcgggaggccguggaggacggccgcuucugggagcugguggaccgggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgccggcugggacacgcggaucacccuggaggaccucaagaacgaggagauggugaccaaccacaugaagggggagcacaagaagcuggcggaggccaucuucaagcugaccuaccagaacaaggugguccgcgugcagcggccgacgccccgcggcaccgugauggacaucaucucccggcgcgaccagcggggcagcgggcaggucggcaccuacgggcucaacaccuucacgaacauggaggcccagcugauccgccagauggagggcgagggcaucuucaaguccauccagcaccugaccgccaccgaggagaucgccgugcagaacuggcucgcgcgcguggggcgggagcgccugagccggauggccaucuccggcgacgacugcgucgugaagcccaucgacgaccgcuucgccagcgcccugaccgcccucaacgacauggggaaggugcggaaggacauccagcagugggagcccucccgcggcuggaacgacuggacgcaggucccguucugcagccaccacuuccacgagcuggugaugaaggacgggcgggugcuggucgugcccugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugccgccccacugggucccgaccucccgcaccacguggagcauccacgccaagcacgaguggaugaccaccgaggacaugcucgcgguguggaaccggguguggauccaggagaaccccuggauggaggacaagacccccgucgaguccugggaggaggugcccuaccuggggaagcgcgaggaccaguggugcggcagccugaucgggcucacgucccgggccaccugggccaagaacauccagaccgccaucaaccaggugcgcagccugaucggcaacgaggaguacaccgacuacaugccgagcaugaagcgguuccgccgcgaggaggaggaggccggcguccugugguga

SEQ ID NO: 9198 - RNA, 9876 nt, Artificial Sequence
  derived and/or modified CDS sequence (opt1) from DENV-2__GU131955__SS-prME
accgcgggcgugaucgucaugcugauccccaccgugauggccuuccaccucaccacccggaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcuccaccaccggcgagcaccggcgcgagaagcggagcguggcccuggucccccacguggggaugggccucgagacgcgcaccgagaccuggaugagcagcgagggggccuggaagcacgugcagcggaucgagaccuggauccugcgccacccgggcuucacgaucauggccgccauccuggcguacaccaucgggaccacccacuuccagcgggcccucaucuucauccugcugacggccgucgcccccagcaugaccaugcgcugcaucggcaucagcaaccgggacuucguggagggcguguccgggggcagcugggucgacaucgugcucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcauggucgaccggggcugggggaacggcugcgggcuguucggcaagggcgggaucgugacgugcgccauguucacgugcaagaagaacauggagggcaaggugguccagcccgagaaccuggaguacaccaucgugaucacgccccacuccggggaggagcacgcggugggcaacgacacggggaagcacggcaaggagaucaagaucaccccgcagagcuccaucaccgaggccgagcugaccggguacggcaccgucacgauggagugcagcccccgcaccggccucgacuucaacgagauggugcugcugcagauggaggacaaggccuggcucgugcaccggcagugguuccuggaccugccccuccccuggcugccgggggccgacacccagggcuccaacuggauccagaaggagacccuggucacguucaagaacccccacgccaagaagcaggacguggucgugcucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgucauccgcgugcaguacgagggcgacggcagccccugcaagauccccuucgagaucacggaccuggagaagcggcacgugcucgggcgccugaucaccgucaacccgaucgugaccgagaaggacucccccgugaacaucgaggccgagccgcccuucggcgacagcuacaucaucaucggggucgagccgggccagcugaagcucaacugguucaagaagggguccagcaucggccagauguucgagaccacgaugcgcggcgcgaagcggauggccauccugggggacaccgccugggacuucggcucccucgggggcguguucaccagcaucgggaaggcccuccaccagguguucggcgccaucuacggcgcggccuucuccggggucagcuggaccaugaagauccugaucggcgugaucaucacguggaucgggaugaacucccgcagcaccucccugagcgugucccugguccucgugggcguggucacccuguaccugggggccauggugcaggccgacagcggcugcguggucuccuggaagaacaaggagcucaagugcggcagcgggaucuucaucaccgacaacgugcacacguggaccgagcaguacaaguuccagcccgagagccccuccaagcuggcgagcgccauccagaaggcccacgaggagggcaucugcgggauccgguccgugacccgccuggagaaccucauguggaagcagaucacccccgagcugaaccacauccugagcgagaacgaggucaagcucacgaucaugaccggcgacaucaaggggaucaugcaggccggcaagcggucccugcgcccgcagcccaccgagcugaaguacagcuggaagaccuggggcaaggccaagaugcucuccacggagagccacaaccagaccuuccugaucgacgggcccgagaccgcggagugcccgaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggccgugcacgcggacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagacggccgggcccuggcaccucggcaagcuggagauggacuucgaccugugcgaggggaccaccguggucgugaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcaucggcaccaagcacgccauccuccugguggcggccuccuucgucacgcugaucaccgggaacaugagcuuccgggaccucggccgcgugauggugauggucggggccaccaugaccgacgacaucggcaugggcgugacguaccuggcccugcucgccgcguucaaggugcgccccaccuucgccgccgggcugcugcuccggaagcugaccuccaaggagcugaugauggccaccaucggcaucgcccuccugagccaguccacgauccccgagaccauccuggagcucaccgacgcgcuggcccuggggaugaugguccucaagaucgugcgcaacauggagaaguaccagcuggccgugaccaucauggccaucagcugcgucccgaacgccgugauccugcagaacgcguggaagguguccugcacgauccucgccgccgucagcgugagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccgucauggccgugggcaugguguccauccuggccagcagccugcucaagaacgacauccccaugaccgggccccuggucgcgggcgggcugcucacggugugcuacgugcugaccggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugacgauccucauccggaccggccugcuggugaucuccgggguguucccggucagcauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacagccagaucggcgccggcguguacaaggaggggaccuuccacaccauguggcacgucacgcggggcgccgugcugaugcaccgcgggaagcggaucgagcccuccugggccgacgugaagaaggaccugaucagcuacggcgggggcuggaagcucgagggcgaguggaaggagggggaggagguccaggugcuggcccuggagcccggcaagaacccccgcgcggugcagaccaagcccgggaucuucaagaccaacaccggcacgaucggggccgucucccucgacuucagccccggcaccuccggcagccccaucguggaccggaaggggaagguggucggccuguacgggaacggcguggugacccgcuccggcgccuacgucagcgccaucgcgcagaccgagaaguccaucgaggacaaccccgagaucgaggacgacaucuuccggaagaagcgccugacgaucauggaccuccaccccggggccggcaagaccaagcgguaccugcccgccaucgugcgcgaggccaucaagcgggggcugcgcacccugauccucgccccgacccgcguggucgcggccgagauggaggaggcccugcggggccugcccauccgcuaccagacgcccgccaucaagaccgagcacaccgggcgggagaucguggaccucaugugccacgccaccuucacgaugcgccugcugucccccgugcgggucccgaacuacaaccucaucaucauggacgaggcgcacuucaccgaccccgccagcaucgccgcccgcggcuacaucuccacccggguggagaugggcgaggccgcggggaucuucaugaccgccacgccgcccggcagccgcgacccguucccccaguccaacgcccccaucauggacgaggagcgggagauccccgagcgcagcuggaacuccgggcacgagugggugaccgacuucaagggcaagaccgucugguucgugccgagcaucaaggccgggaacgacaucgcggccugccugcggaagaacggcaagaaggugauccagcugucccgcaagaccuucgacagcgaguacgucaagacgcgggccaacgacugggacuucguggugaccaccgacaucuccgagaugggcgccaacuucaaggccgagcgcgucaucgacccccggcgcugcaugaagcccgugauccucaccgacggggaggagcgggugauccuggcgggccccaugccggucacgcacagcuccgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccgcaagaccuucguggaccucaugcggcgcggcgaccugcccgucuggcuggccuacaagguggccgccgaggggaucaacuacgcggaccggaaguggugcuucgacggcaucaagaacaaccagauccucgaggagaacauggagguggagaucuggaccaaggagggggagcgcaagaagcugaagccgcgguggcuggacgcccgcaucuacuccgacccccucgcccugaaggaguucaaggaguucgccgcgggccgcaagagccugacgcucaaccugaucaccgagaugggccgccugcccaccuucaugacccagaaggcccggaacgcccucgacaaccuggccguccugcacacggccgaggccgggggccgcgccuacaaccacgcccucuccgagcugcccgagacccuggagacccuccugcugcucacccugcuggccacggugaccgggggcaucuuccucuuccugaugagcggcaaggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcagcaucacgacccaggaguccgagagcaacauccuggacaucgaccuccgcccggccuccgccuggacccuguacgccguggcgaccacguucgucacccccaugcugcggcacagcaucgagaacuccagcgugaacgugucccucaccgccaucgccaaccaggccaccguccugaugggccuggggaagggcuggccccucagcaagauggacaucggggugccccugcuggcgaucggcugcuacucccaggugaacccgaucacgcucaccgccgcccugcugcuccuggucgcccacuacgccaucaucgggcccggccugcaggcgaaggccacccgcgaggcccagaagcgggccgccgcgggcaucaugaagaaccccaccguggacgggaucacggugaucgaccucgagcccaucccguacgaccccaaguucgagaagcagcugggccaggucaugcugcucauccugugcgugacccaggugcugaugaugcgcaccaccugggcccucugcgaggcccugacgcuggccaccgggcccaucagcacccucugggagggcaaccccgggcgguucuggaacaccacgaucgccgucuccauggcgaacaucuuccgcggcagcuaccuggccggcgccgggcuccuguucuccaucaugaagaacaccaccaacacccgccggggcacggggaacaucggcgagacccugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugucccgggggagcgccaagcugcgcugguucgucgagcggaacauggugacgccggagggcaagguggucgaccucggcugcgggcgcggcgggugguccuacuacugcggcgggcugaaggacgugcgggaggugaagggccugaccaagggcgggcccggccacgaggagcccauccccaugagcaccuacggguggaaccucguccgccugcagagcggcaucgacguguucuucaccccgcccgagaagugcgacacgcugcucugcgacaucggggaguccagccccaaccccaccaucgaggccggccggacccugcgcgugcugaaccucgucgagaacuggcugaacaacaacacccaguucugcaucaaggugcugaacccguacaugcccuccgugaucgagaagauggagacccuccagcggaaguacggcggggcccugguccgcaacccccugagccggaacuccacgcacgagauguacugggugagcaacgcgaccggcaacaucguguccagcgucaacaugaucucccgcaugcugaucaaccgguucaccaugaagcacaagaaggccaccuacgagccggacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacguggucccgauggugacccagauggccaugaccgacacgacccccuucgggcagcagcgcguguucaaggagaaggucgacacccggacccaggagcccaaggagggcacgaagaagcugaugaagaucaccgcggaguggcuguggaaggagcucggcaagaagaagacgccccggaugugcacccgggaggaguucacgcgcaaggugcgguccaacgccgcccugggggccaucuucaccgacgagaacaaguggaaguccgcccgcgaggcgguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcccgcuuccuggaguucgaggcgcugggcuuccucaacgaggaccacugguucagccgggggaacagccuguccggcguggagggggagggccugcaccgccucggcuacauccugcgggacgucgggaagaaggagggcggggccauguacgccgacgacaccgccggcugggacacgcgcaucacccuggaggaccucaagaacgaggagauggugaccaaccacaugaagggggagcacaagaagcuggccgaggcgaucuucaagcugaccuaccagaacaaggucgugcgggugcagcgcccgacgccccggggcaccgucauggacaucaucagccgccgggaccagcgcggcuccggccaggugggcaccuacgggcucaacaccuucacgaacauggaggcccagcugauccgccagauggagggcgagggcaucuucaagagcauccagcaccugaccgccaccgaggagaucgccgugcagaacuggcucgcccgggucgggcgcgagcggcugucccgcauggcgaucagcggcgacgacugcguggugaagcccaucgacgaccgguucgccuccgcccugaccgcccucaacgacauggggaagguccgcaaggacauccagcagugggagcccagccggggcuggaacgacuggacccaggugccguucugcucccaccacuuccacgagcuggugaugaaggacgggcgcguccugguggugcccugccggaaccaggacgagcucaucggccgcgcccggaucagccagggcgcgggguggucccugaaggagaccgccugccugggcaagagcuacgcccagauguggacccucauguacuuccaccgccgggaccugcgccuggccgccaacgcgaucugcuccgccguccccagccacugggugcccaccucccggaccacguggagcauccacgccaagcacgaguggaugaccaccgaggacaugcucgccguguggaaccgcgucuggauccaggagaacccguggauggaggacaagacccccguggaguccugggaggaggugcccuaccuggggaagcgggaggaccaguggugcggcagccugaucgggcucacgagccgcgcgaccugggccaagaacauccagaccgccaucaaccagguccggucccugaucggcaacgaggaguacaccgacuacaugcccagcaugaagcgcuuccgcaaggaggaggaggaggccggcgugcugugguga

SEQ ID NO: 9199 - RNA, 9876 nt, Artificial Sequence
  derived and/or modified CDS sequence (opt1) from DENV-2__KJ189311__SS-prME
accgcgggcgugaucgucaugcugauccccaccgugauggccuuccaccucaccacccggaacggggagccgcacaugaucgugggccggcaggagaagggcaagagccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacuccaccagcaccuggaucaccuacgggaccugcuccaccaccggcgagcaccggcgcgagaagcggagcguggcccuggugccccacgucgggaugggccucgagacccgcaccgagaccuggauguccagcgagggggccuggaagcacgugcagcggaucgagaccuggauccugcgccacccgggcuucaccaucauggccgccauccuggcguacaccaucgggaccacccacuuccagcgggcccucaucuucauccugcugacggccguggcccccuccaugaccaugcgcugcaucggcaucagcaaccgggacuucgucgagggcguguccgggggcagcuggguggacaucguccucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcaugguggaccggggcugggggaacggcugcgggcuguucggcaagggcgggaucgucacgugcgccauguucacgugcaagaagaacauggagggcaagguggugcagcccgagaaccuggaguacaccaucgucaucacgccccacuccggggaggagcacgcggugggcaacgacacggggaagcacggcaaggagaucaagaucaccccgcagagcuccaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacccuggugacguucaagaacccccacgccaagaagcaggacgucgugguccucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgugauccgcguccaguacgagggcgacggcagccccugcaagauccccuucgagaucacggaccuggagaagcggcacgugcucgggcgccugaucaccgugaacccgaucgucaccgagaaggacucccccgugaacaucgaggccgagccgcccuucggcgacagcuacaucaucaucgggguggagccgggccagcugaagcucaacugguucaagaagggguccagcaucggccagauguucgagaccacgaugcgcggcgcgaagcggauggccauccugggggacaccgccugggacuucggcucccucggcggggucuucaccagcaucgggaaggcccuccaccagguguucggggccaucuacggcgcggccuucuccggggugagcuggaccaugaagauccugaucggcgucaucaucacguggaucgggaugaacucccgcagcaccucccugagcgugucccuggugcucgucggcguggugauccuguaccugggggccaugguccaggccgacagcggcugcgugguguccuggaagaacaaggagcucaagugcggcagcgggaucuucaucaccgacaacguccacaccuggacggagcaguacaaguuccagcccgagagccccuccaagcuggcgagcgccauccagaaggcccacgaggagggcaucugcgggauccgguccgugacccgccuggagaaccucauguggaagcagaucacccccgagcugaaccacauccugagcgagaacgaggugaagcucaccaucaugacgggcgacaucaaggggaucaugcaggccggcaagcggucccugcgcccgcagcccaccgagcugaaguacagcuggaagaccuggggcaaggccaagaugcucuccaccgagagccacaaccagacguuccugaucgacgggcccgagaccgcggagugcccgaacaccaaccgggccuggaacucccuggaggucgaggacuacggcuucgggguguucaccacgaacaucuggcucaagcugcgcgagaagcaggacguguucugcgacagcaagcugauguccgccgccaucaaggacaaccgggccguccacgcggacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagaccgccgggcccuggcaccucggcaagcuggagauggacuucgaccugugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcaucggcaccaagcacgccauccuccugguggcggccuccuucgugacccugaucacggggaacaugagcuuccgggaccucggccgcgucauggugauggugggggccaccaugaccgacgacaucggcaugggcgucaccuaccuggcccugcucgccgcguucaaggugcgccccacguucgccgccgggcugcugcuccggaagcugaccuccaaggagcugaugauggccaccaucggcaucgcccuccugagccaguccaccauccccgagagcauccuggagcucacggacgcgcuggcccuggggaugauggugcucaagaucguccgcaacauggagaaguaccagcuggccgugaccaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugacgaucaagggccucaaccccaccgccaucuuccugaccacccugucccggacgagcaagaagcgcuccuggccgcucaacgaggccgugauggccgucggcauggugagcauccuggccagcucccugcucaagaacgacauccccaugaccgggccccugguggcgggcgggcugcucaccgucugcuacgugcugaccggccggagcgccgaccuggagcucgagcgcgccgccgacgugaagugggaggaccaggccgagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucacggcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagacgaacaccggcaccaucggggccgugagccucgacuucucccccggcaccagcggcucccccaucgucgaccggaaggggaagguggugggccuguacgggaacggcgucgugacgcgcagcggcgccuacgugagcgccaucgcgcagaccgagaaguccaucgaggacaaccuggagaucgaggacgacaucuuccggaagaagcgccucaccaucauggaccugcaccccggggccggcaagaccaagcgguaccugcccgccaucguccgcgaggccaucaagcgggggcugcgcacgcucauccuggcccccacccgcgugguggcggccgagauggaggaggcccugcggggccucccgauccgcuaccagacccccgccaucaagaccgagcacacggggcgggagaucgucgaccugaugugccacgccaccuucaccaugcgccugcucagccccgugcgggugcccaacuacaaccugaucaucauggacgaggcgcacuucaccgacccggccuccaucgccgcccgcggcuacaucagcacgcgggucgagaugggcgaggccgcggggaucuucaugaccgccacgccgcccggcucccgcgaccccuucccgcagagcaacgcccccaucauggacgaggagcgggagauccccgagcgcuccuggaacagcgggcacgagugggugaccgacuucaagggcaagacggugugguucguccccuccaucaaggccgggaacgacaucgcggccugccugcggaagaacggcaagaaggugauccagcucagccgcaagaccuucgacuccgaguacgugaagacccgggccaacgacugggacuucgucgugaccacggacaucagcgagaugggcgccaacuucaaggccgagcgcgugaucgacccgcggcgcugcaugaagcccgucauccugaccgacggggaggagcgggugauccuggcgggccccaugcccgugacccacuccagcgccgcccagcgccgggggcgcaucggccgcaacccgaagaacgagaacgaccaguacaucuacaugggggagccccucgagaacgacgaggacugcgcccacuggaaggaggccaagaugcugcuggacaacaucaacacccccgagggcaucauccccuccauguucgagccggagcgggagaaggucgacgcgaucgacggcgaguaccgccuccgcggggaggcccgcaagacguucguggaccugaugcggcgcggcgaccugcccguguggcucgccuacaaggucgccgccgaggggaucaacuacgcggaccggaaguggugcuucgacggcaucaagaacaaccagauccuggaggagaacauggagguggagaucuggaccaaggagggggagcgcaagaagcugaagccccgguggcucgacgcccgcaucuacagcgacccgcuggcccugaaggaguucaaggaguucgccgcgggccggaagucccucacccugaaccugaucaccgagaugggccgccuccccacguucaugacccagaaggcccggaacgcccuggacaaccuggccgugcuccacaccgccgaggccgggggccgcgccuacaaccacgcccugagcgagcugcccgagacccucgagacgcugcugcuccugacccugcucgccaccgucaccgggggcaucuuccuguuccugauguccggcaaggggaucggcaagaugacgcucgggaugugcugcaucaucaccgccagcauccugcugugguacgcgcagauccagccccacuggaucgccgccagcaucauccucgaguucuuccugaucgugcugcucaucccggagcccgagaagcagcggacgccccaggacaaccagcugaccuacgucgugaucgccauccugaccguggucgccgcgacgauggccaacgagaugggcuuccucgagaagaccaagaaggaccuggggcugggcuccaucaccacccaggagagcgaguccaacauccucgacaucgaccugcgccccgccagcgccuggacgcuguacgccguggcgaccaccuucgugaccccgaugcuccggcacuccaucgagaacagcuccgucaacgugagccugacggccaucgccaaccaggccaccgugcugaugggccucgggaagggcuggccccuguccaagauggacaucggggucccccugcucgcgaucggcugcuacagccaggugaaccccaucacccugaccgccgcccugcuccugcugguggcccacuacgccaucaucgggccgggccuccaggcgaaggccacgcgcgaggcccagaagcgggccgccgcgggcaucaugaagaaccccaccgucgacgggaucaccgugaucgaccuggagcccauccccuacgacccgaaguucgagaagcagcugggccaggugaugcuccugauccugugcgucacccaggugcucaugaugcgcacgaccugggcccugugcgaggcccugacccucgccaccgggcccaucuccacgcugugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccucaacgcccugggcaagagcgaguuccagaucuacaagaaguccggcauccaggaggucgaccggacgcuggcgaaggaggggaucaagcgcggcgagaccgaccaccacgccgugagccggggguccgccaagcuccgcugguucguggagcggaacauggucacccccgagggcaaggugguggaccugggcugcgggcgcggcggguggagcuacuacugcggcgggcugaaggacguccgggaggugaagggccucaccaagggcgggccgggccacgaggagcccauccccaugagcacguacggguggaaccuggugcgccugcaguccggcaucgacgucuucuucacgccgcccgagaagugcgacacccuccugugcgacaucggggagagcucccccaaccccaccaucgaggccggccggacgcugcgcgugcucaaccugguggagaacuggcugaacaacaacacccaguucugcaucaagguccucaaccccuacaugcccagcgugaucgagaagauggagacccugcagcggaaguacggcggggcccuggugcgcaacccccugucccggaacagcacccacgagauguacugggucuccaacgcgaccggcaacaucgugagcuccgugaacaugaucagccgcaugcucaucaaccgguucacgaugaagcacaagaaggccaccuacgagcccgacgucgaccugggguccggcacccgcaacaucgggaucgagagcgagaucccgaaccuggacaucaucggcaagcggaucgagaagaucaagcaggagcacgagaccuccuggcacuacgaccaggaccaccccuacaagacgugggccuaccacggcagcuacgagaccaagcagaccggguccgccagcuccauggugaacggcgugguccgccuccugaccaagcccugggacguggugcccauggucacgcagauggccaugaccgacaccaccccguucgggcagcagcgcguguucaaggagaagguggacacgcggacccaggagcccaaggagggcaccaagaagcugaugaagaucaccgcggaguggcucuggaaggagcugggcaagaagaagacgccccgcaugugcacccgggaggaguucacccgcaagguccggagcaacgccgcccugggggccaucuucaccgacgagaacaaguggaaguccgcccgcgaggcgguggaggacggccgguucugggagcucguggaccgcgagcggagccugcaccuggaggggaagugcgagacgugcgucuacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggggaacagccuguccggcguggagggggagggccuccaccgccugggcuacauccugcgggacguggggaagaaggagggcggggccauguacgccgacgacaccgccggcugggacacccgcaucacccucgaggaccugaagaacgaggagauggucacgaaccacaugaagggggagcacaagaagcuggccgaggcgaucuucaagcucaccuaccagaacaaggugguccgggugcagcgccccaccccgcggggcaccgugauggacaucaucagccgccgggaccagcgcggcuccgggcaggucggcacguacgggcugaacaccuucaccaacauggaggcccagcugauccgccagauggagggcgagggcaucuucaagaacauccagcaccucaccgccacggaggagaucgccgugcagaacuggcuggcccggguggggcgcgagcggcugagccgcauggcgaucuccggcgacgacugcgucgugaagcccaucgacgaccgguucgccagcgcccucaccgcccugaacgacauggggaaggugcgcaaggacauccagcagugggagcccucccggggcuggaacgacuggacccagguccccuucugcagccaccacuuccacgagcuggugaugaaggacgggcgcgugcucgucgugccgugccggaaccaggacgagcugaucggccgcgcccggaucucccagggcgcgggguggagccugaaggagaccgccugccucggcaaguccuacgcccagauguggacgcugauguacuuccaccgccgggaccugcgccucgccgccaacgcgaucugcagcgccgugcccucccacuggguccccaccagccggaccaccugguccauccacgccaagcacgaguggaugaccacggaggacaugcuggccguguggaaccgcguguggauccaggagaaccccuggauggaggacaagaccccggucgagagcugggaggaggugcccuaccuggggaagcgggaggaccaguggugcggcagccucaucgggcugaccucccgcgcgaccugggccaagaacauccagacggccaucaaccaggugcggagccugaucggcaacgaggaguacaccgacuacaugcccuccaugaagcgcuuccgcaaggaggaggaggaggccggcguccucugguga

SEQ ID NO: 9200 - RNA, 9876 nt, Artificial Sequence
  derived and/or modified CDS sequence (opt1) from DENV-2__KJ189370__SS-prME
accgcgggcgugaucgucaugcugauccccaccgccauggcguuccaccucaccacccggaacggggagccccacaugaucgugucccggcaggagaagggcaagucccugcuguucaagaccgaggacggggugaacaugugcacccucauggccaucgaccugggcgagcugugcgaggacaccaucaccuacaagugcccccuccugcgccagaacgagcccgaggacaucgacugcuggugcaacagcaccuccaccugggucaccuacgggaccugcaccaccaccggcgagcaccggcgggagaagcggagcguggcccuggugccccacgucggcauggggcucgagacccgcaccgagaccuggauguccagcgagggcgccuggaagcacgugcagcggaucgagacguggauccugcgccacccgggguucaccaucauggccgcgauccuggccuacaccaucggcaccacgcacuuccagcgggcccucaucuucauccugcugaccgccguggcgcccuccaugaccaugcgcugcaucgggaucagcaaccgggacuucgucgagggcguguccggcgggagcuggguggacaucguccucgagcacggcuccugcgugaccacgauggccaagaacaagcccacccuggacuucgagcugaucaagaccgaggccaagcagcccgccacccuccgcaaguacugcaucgaggccaagcugacgaacaccaccaccgagagccggugcccgacgcagggggagcccucccugaacgaggagcaggacaagcgcuucaucugcaagcacagcaugguggaccggggcuggggcaacgggugcggccucuucgggaagggcgggaucgugaccugcgcgauguucacgugcaagaagaacauggagggcaagguggugcagcccgagaaccuggaguacaccaucgucaucacgccccacuccggcgaggagcacgccguggggaacgacaccggcaagcacgggaaggagaucaagaucaccccgcagagcuccaucaccgaggccgagcugaccggcuacgggacggugaccauggagugcagcccccgcaccggccucgacuucaacgagaugguccugcugcagauggaggacaaggccuggcucgugcaccggcagugguuccuggaccugccccuccccuggcugccgggcgccgacacccagggguccaacuggauccagaaggagacgcuggugaccuucaagaacccccacgcgaagaagcaggacgucgugguccucggcagccaggagggggccaugcacaccgcccugaccggcgccacggagauccagaugagcuccgggaaccuccuguucaccggccaccugaagugccgccugcggauggacaagcuccagcugaagggcaugagcuacuccaugugcaccgggaaguucaagaucgugaaggagaucgccgagacccagcacggcacgaucgugauccgcguccaguacgagggggacggcagccccugcaagauccccuucgagaucaccgaccuggagaagcggcacgugcucggccgccugaucaccgugaacccgaucgucaccgagaaggacucccccgugaacaucgaggcggagccgcccuucggggacagcuacaucaucaucggcguggagccggggcagcugaagcucaacugguucaagaagggcuccagcaucgggcagauguucgagacgaccaugcgcggcgccaagcggauggccauccugggcgacaccgccugggacuucgggucccugggcggggucuucaccagcaucggcaaggcccuccaccagguguucggggcgaucuacggcgccgccuucuccggcgugagcuggacgaugaagauccugaucggggucaucaucaccuggaucggcaugaacucccgcagcaccucccugagcgugucccuggugcucgucgggguggugacccuguaccugggcgccaugguccaggcggacagcgggugcgugguguccuggaagaacaaggagcucaagugcggcagcggcaucuucaucacggacaacguccacaccuggaccgagcaguacaaguuccagcccgagagccccuccaagcuggccagcgccauccagaaggcccacgaggaggggaucugcggcauccgguccgugacccgccuggagaaccucauguggaagcagaucacgcccgagcugaaccacauccugagcgagaacgaggugaagcucaccaucaugaccggggacaucaagggcaucaugcaggccgggaagcggucccugcgcccgcagcccaccgagcugaaguacagcuggaagacguggggcaaggcgaagaugcucuccaccgagagccacaaccagaccuuccugaucgacggccccgagaccgccgagugcccgaacacgaaccgggccuggaacucccuggaggucgaggacuacggguucggcguguucaccaccaacaucuggcucaagcugaaggagaagcaggacguguucugcgacagcaagcugauguccgccgccaucaaggacaaccgcgcgguccacgccgacaugggguacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccggccccgugagccagcacaacuaccggccgggguaccacacgcagaccgcgggccccuggcaccucgggaagcuggagauggacuucgaccugugcgagggcaccaccgugguggucacggaggacugcgggaaccgcggccccagccuccggaccaccaccgccuccggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcagaucgacaacuucagccugggcguccugggcauggcccucuuccuggaggagaugcugcgcacccggaucgggacgaagcacgcgauccuccugguggccguguccuucgucacccugaucaccggcaacaugagcuuccgcgaccucgggcgggugauggugauggucggcgccaccaugacggacgacaucgggaugggcgugaccuaccuggcccugcucgccgcguucaaggugcgccccaccuucgccgccggccugcugcuccgcaagcugaccuccaaggagcugaugauggccacgaucgggaucgcccuccugagccaguccaccauccccgagaccauccuggagcucaccgacgcgcuggcccugggcaugaugguccucaagguggugcggaacauggagaaguaccagcuggccgucacgaucauggccaucagcugcgugccgaacgccgugauccugcagaacgcguggaaggucuccugcaccauccucgccgccgugagcgucagcccccugcugcucaccagcucccagcagaaggccgacuggaucccccuggcgcugaccaucaaggggcucaaccccacggccaucuuccugaccacccugagccgcaccuccaagaagcggagcuggccgcucaacgaggccaucauggccgugggcaugguguccauccuggccagcagccugcucaagaacgacauccccaugacgggcccccuggucgccggcgggcugcucaccgugugcuacgugcugaccgggcgcuccgccgaccuggagcucgagcgggccgccgacgucaagugggaggaccaggccgagaucagcggguccagccccauccuguccaucaccaucagcgaggacggguccaugagcaucaagaacgaggaggaggagcagacgcugaccauccucauccgcaccggccugcuggugaucuccggcguguucccggucagcauccccaucaccgcggccgccugguaccucugggaggugaagaagcagcgggccggggugcugugggacguccccagcccgccgcccguggagaaggccgagcuggaggacggcgcguaccgcaucaagcagcgggggauccucggcuacagccagaucggggccggcguguacaaggagggcaccuuccacacgauguggcacgucacccgcggggccgugcugaugcaccggggcaagcgcaucgagcccuccugggccgacgugaagaaggaccugaucagcuacgggggcggguggaagcucgagggcgaguggaaggagggcgaggagguccaggugcuggcccuggagcccgggaagaacccccgggcggugcagaccaagcccggcaucuucaagaccaacacggggaccaucggcgccgucucccucgacuucagccccgggaccuccggcagccccaucguggaccgcaagggcaagguggucgggcuguacggcaacgggguggugacccgguccggcgccuacgucagcgccaucgcgcagacggagaaguccaucgaggacaaccccgagaucgaggacgacaucuuccgcaagaagcggcugaccaucauggaccuccaccccggcgccgggaagaccaagcgcuaccugcccgccaucgugcgggaggccaucaagcgcggccugcggacccugauccucgccccgacgcgcguggucgcggccgagauggaggaggcccugcgcgggcugcccauccgguaccagacccccgccaucaaggccgaguacaccggccgcgagaucguggaccucaugugccacgcgaccuucacgaugcggcugcugucccccgugcgcgucccgaacuacaaccucaucaucauggacgaggcccacuucaccgaccccgccagcaucgccgcccggggguacaucuccacccgcguggagaugggcgaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggcgggcaacgacaucgccgccugccugcgcaagaacgggaagaaggugauccagcugucccggaagaccuucgacagcgaguacgucaagacgcgcgccaacgacugggacuucguggugaccaccgacaucuccgagaugggcgccaacuucaaggcggagcgggucaucgacccccgccggugcaugaagcccgugauccucaccgacggcgaggagcgcgugauccuggccgggcccaugccggucacgcacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacccccgaggggaucaucccgagcauguucgagcccgagcgcgagaagguggacgccaucgacggcgaguaccggcugcgcggcgaggcccggaagaccuucguggaccucaugcgccgcggggaccugcccgucuggcuggccuacaagguggccgcggagggcaucaacuacgccgaccgcaaguggugcuucgacgggaucaagaacaaccagauccucgaggagaacauggagguggagaucuggaccaaggagggcgagcggaagaagcugaagccgcgcuggcuggacgcccggaucuacuccgacccccucgcccugaaggaguucaaggaguucgcggccgggcgcaagagccugacgcucaaccugaucaccgagaugggccggcugcccaccuucaugacccagaaggcccgcaacgcccucgacaaccuggccguccugcacacggcggaggccggcgggcgggccuacaaccacgcccucuccgagcugcccgagacccuggagacccuccugcugcucacccugcuggccacggugaccggcgggaucuuccucuuccugaugagcggcaagggcaucgggaagaugacccugggcaugugcugcaucaucaccgcguccauccuccugugguacgcccagauccagccgcacuggaucgccgccagcaucauccuggaguucuuccucaucguccugcugauccccgagcccgagaagcagcgcacgccccaggacaaccagcucacguacguggugaucgccauccugaccgucguggcggccaccauggccaacgagaugggguuccuggagaagaccaagaaggaccucggccuggggagcaucacgacccaggaguccgagagcaacauccuggacaucgaccuccggccggccuccgccuggacccuguacgcgguggccaccacguuccugacccccaugcuccgccacagcaucgagaacuccagcgucaacgugucccugaccgccaucgccaaccaggcgaccgugcugaugggccucggcaagggguggccccugagcaagauggacaucggcgucccccugcucgccaucgggugcuacucccaggugaacccgaucacgcugaccgccgcccugcuccugcugguggcccacuacgcgaucaucggccccgggcuccaggccaaggccacccgggaggcccagaagcgcgccgcggccggcaucaugaagaaccccaccgucgacggcaucacggugaucgaccuggaccccaucccguacgaccccaaguucgagaagcagcuggggcaggucaugcuccugauccugugcgucacccaggugcucaugaugcggaccaccugggcccugugcgaggcccugacgcucgccaccggccccaucagcacccugugggaggggaaccccggccgcuucuggaacaccacgaucgcgguguccauggccaacaucuuccgggggagcuaccuggccggcgccggccuccuguucuccaucaugaagaacaccaccagcacccgccgcgggacgggcaacaucggggagacccugggcgagaaguggaagucccggcucaacgcgcugggcaagagcgaguuccagaucuacaagaaguccgggauccaggaggucgaccgcacccuggccaaggagggcaucaagcgcggggagaccgaccaccacgccgugagccgcggcuccgccaagcuccggugguucguggagcgcaacauggucacgccggaggggaaggugguggaccugggcugcggccgcgggggcuggagcuacuacugcgggggccugaagaacguccgcgaggugaaggggcucaccaagggcggccccgggcacgaggagcccauccccaugagcaccuacggcuggaaccuggugcggcugcaguccggggucgacguguucuucaccccgcccgagaagugcgacacgcuccugugcgacaucggcgagagcucccccaaccccaccaucgaggccgggcgcacccugcgggugcucaaccuggucgagaacuggcugaacaacaacacccaguucugcaucaaggugcucaacccguacaugcccagcgugaucgagaagauggaggcgcugcagcgcaaguacggcggcgcccugguccggaacccccugucccgcaacagcacccacgagauguacuggguguccaacgccacggggaacaucgugagcuccgucaacaugaucagccggaugcucaucaaccgcuucaccaugaagcacaagaaggccaccuacgagccggacguggaccugggcuccgggacccggaacaucggcaucgagagcgaggugcccaaccuggacaucaucgggaagcgcaucgagaagaucaagcaggagcacgagacguccuggcacuacgaccaggaccaccccuacaagaccugggccuaccacggcagcuacgagaccaagcagaccggcuccgcgagcuccauggucaacgggguggugcggcuccugacgaagcccugggacgucgugccgauggugacccagauggccaugaccgacaccacgcccuucggccagcagcgcgucuucaaggagaagguggacacccgcacccaggagcccaaggaggggaccaagaagcugaugaagaucacggccgaguggcucuggaaggagcugggcaagaagaagacgccccggaugugcacccgcgaggaguucacccggaaggugcgcagcaacgccgcccugggcgcgaucuucacggacgagaacaaguggaaguccgcccgggaggccgucgaggacgggcgcuucugggagcucguggaccgggagcgcaaccugcaccuggagggcaagugcgagaccugcguguacaacaugauggggaagcgggagaagaagcucggcgaguucgggaaggccaagggcagccgcgcgaucugguacauguggcugggcgcccgguuccuggaguucgaggcccucggguuccugaacgaggaccacugguucagccgcggcaacucccugagcggggucgagggcgaggggcuccaccggcugggcuacauccugcgcgaggugggcaagaaggagggcggcgccauguacgccgacgacaccgcggggugggacacccggaucacgcucgaggaccugaagaacgaggagauggucaccaaccacaugaagggcgagcacaagaagcuggccgaggccaucuucaagcucaccuaccagaacaagguggugcgcguccagcggccgacgccccgggggacggugauggacaucaucucccggcgcgaccagcggggcagcggccagguggggaccuacggccugaacaccuucaccaacauggaggcccagcugauccgccagauggagggggagggcaucuucaaguccauccagcaccucacggccaccgaggagaucgcgguccagaacuggcuggugcgcgugggccgggagcgccugagccggauggccaucuccggggacgacugcgucgugaagcccaucgacgaccgcuucgccagcgcccucaccgcccugaacgacaugggcaaggugcggaaggacauccagcagugggagcccucccgcggguggaacgacuggacccaggucccguucugcagccaccacuuccacgagcuggugaugaaggacggccgggugcucgucgugcccugccgcaaccaggacgagcugaucgggcgggcgcgcaucucccagggcgccggcuggagccugaaggagacggccugccucgggaaguccuacgcccagauguggacccugauguacuuccaccggcgcgaccugcggcucgccgcgaacgccaucugcagcgccgugcccucccacuggguccccaccagccgcaccaccugguccauccacgccaagcacgaguggaugacgaccgaggacaugcuggcgguguggaaccggguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9201 - RNA, 9876 nt, Artificial Sequence
  derived and/or modified CDS sequence (opt1) from DENV-2__EU482620__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacacggaccggaaguggugcuucgacggcaucaagaacaaccagauccuggaggagaacauggagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucaccgagaugggccgccugcccacguucaugacccagaaggcgcggaacgcccuggacaaccucgccguccugcacaccgccgaggccgggggccgcgcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcggacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcgcccggccagcgccuggacgcucuacgccguggccaccaccuucgucacccccaugcugcggcacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgcgaggcccagaagcgggccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcgcacgaccugggcgcugugcgaggcccucacccuggccaccgggcccaucuccacgcugugggagggcaaccccgggcgguucuggaacaccaccaucgccgucagcauggccaacaucuuccgcggcuccuaccucgcgggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgccaaggaggggaucaagcgcggcgagaccgaccaccacgcggugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcacguacggguggaaccugguccgccuccagagcggcguggacguguucuucaccccgcccgagaagugcgacacccugcugugcgacaucggggaguccagccccaaccccaccaucgaggccggccggacccuccgcguccugaaccugguggagaacuggcucaacaacaacacgcaguucugcaucaaggugcugaacccguacaugcccuccgucaucgagaagauggaggcccugcagcggcaguacggcggggcccucgugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcugaccaagcccugggacgucgugccgauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagacgccccgcaugugcacccgggaggaguucacgcgcaaggugcgguccaacgccgcccucggggccaucuucaccgacgagaacaaguggaaguccgcccgcgaggcggucgaggacggccgguucugggagcugguggaccgcgagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggggaacagccucuccggcgucgagggggagggccugcaccgccugggcuacauccuccgggacguggggaagaaggagggcggggccauguacgccgacgacaccgccggcugggacacgcgcaucacccuggaggaccugaagaacgaggagauggucaccaaccacaugaagggggagcacaagaagcucgccgaggcgaucuucaagcugaccuaccagaacaagguggugcggguccagcgcccgacgccccggggcaccgugauggacaucaucagccgccgggaccagcgcggcuccgggcaggucggcaccuacgggcugaacaccuucacgaacauggaggcccagcucauccgccagauggagggcgagggcaucuucaagagcauccagcaccugaccgccaccgaggagaucgccguccagaacuggcuggcccggguggggcgcgagcggcucucccgcauggcgaucagcggcgacgacugcguggucaagcccaucgacgaccgguucgccuccgcccugaccgcccugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcccggaucagccagggcgcgggguggucccucaaggagaccgccugccugggcaagagcuacgcccagauguggacccugauguacuuccaccgccgggaccuccgccuggccgccaacgcgaucugcuccgccgugcccagccacugggugcccaccucccggaccacguggagcauccacgccaagcacgaguggaugaccaccgaggacaugcuggccgucuggaaccgcguguggauccaggagaacccguggauggaggacaagacccccguggaguccugggaggagguccccuaccucgggaagcgggaggaccaguggugcggcagccugaucgggcugacgagccgcgcgaccugggccaagaacauccagaccgccaucaaccaggugcggucccucaucggcaacgaggaguacaccgacuacaugcccagcaugaagcgcuuccgccgggaggaggaggaggccggcgugcugugguga

SEQ ID NO: 9202 - RNA, 9876 nt, Artificial Sequence
  derived and/or modified CDS sequence (opt1) from DENV-2__FJ373300__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaccaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacgguggucgugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacgcgcaucggcaccaagcacgcgauccugcucguggccgucagcuucgugacccugaucaccgggaacauguccuuccgggaccugggccgcgugauggucauggugggggccacgaugaccgacgacaucggcaugggcgugaccuaccucgcccugcuggccgcguucaagguccgccccaccuucgccgccgggcuccugcugcggaagcucacgagcaaggagcugaugauggccaccaucggcaucgcccugcucucccagagcaccauccccgagaccauccuggagcugacggacgcgcucgcccuggggaugauggugcugaagaucgugcgcaacauggagaaguaccagcucgccgucaccaucauggccaucuccugcgugccgaacgccgugauccugcagaacgcguggaaggucagcugcaccgugcuggccgccgucuccgugagcccccuccugcugaccuccagccagcagaaggccgacuggaucccccucgcgcugacgaucaagggccugaaccccaccgccaucuuccucaccacccugucccggacgagcaagaagcgcuccuggccgcugaacgaggccaucauggccgugggcauggucagcauccucgccuccagccugcugaagaacgacauccccaugaccgggccccucguggcgggcgggcugcugaccgugugcuacguccucaccggccggagcgccgaccuggagcuggagcgcgccgccgacgugaagugggaggaccaggccgagaucuccgggagcucccccauccucagcaucacgaucuccgaggacggcagcauguccaucaagaacgaggaggaggagcagacccugaccauccugauccggaccggccuccuggugaucagcggggucuucccgguguccauccccaucaccgcggccgccugguaccugugggaggugaagaagcagcgcgccggcguccucugggacgugcccagcccgccgcccguggagaaggccgagcuggaggacggggcguaccggaucaagcagcgcggcauccugggguacucccagaucggcgccggcgucuacaaggaggggacguuccacaccauguggcacgugacccggggcgccgugcucaugcaccgcgggaagcggaucgagcccagcugggccgacgucaagaaggaccugaucuccuacggcgggggcuggaagcuggagggcgaguggaaggagggggaggagguccaggugcucgcccuggagcccggcaagaacccccgcgcgguccagaccaagcccgggaucuucaagacgaacaccggcaccaucggggccgugagccuggacuucucccccggcaccagcggcucccccaucguggaccggaaggggaaggucgugggccucuacgggaacggcguggucacgcgcagcggcgccuacguguccgccaucgcgcagaccgagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacgcugauccuggccccgacccgcgucguggcggccgagauggaggaggcccuccggggccugcccauccgcuaccagacccccgccaucaagaccgagcacacggggcgggagaucguggaccugaugugccacgccaccuucaccaugcgccuccugagccccguccgggugccgaacuacaaccugaucaucauggacgaggcgcacuucaccgaccccgccuccaucgccgcccgcggcuacaucagcacgcggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggucaccgacuucaagggcaagacggugugguucgugccguccaucaaggccgggaacgacaucgcggccugccuccggaagaacggcaagaaggucauccagcugagccgcaagaccuucgacuccgaguacgugaagacccgggccaacgacugggacuucguggucaccacggacaucagcgagaugggcgccaacuucaaggccgagcgcgugaucgacccccggcgcugcaugaagcccgugauccugaccgacggggaggagcgggucauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagacguucgucgaccugaugcggcgcggcgaccuccccguguggcuggccuacaagguggccgccgaggggaucaacuacgcggaccggaaguggugcuucgacggcaucaagaacaaccagauccuggaggagaacauggaggucgagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggcccggaacgcccuggacaaccucgccgugcugcacaccgccgaggccgggggccgcgccuacaaccacgcccugagcgagcuccccgagacccuggagacgcugcuccugcugacccuccuggccaccgucaccgggggcaucuuccuguuccucauguccggcaaggggaucggcaagaugacccuggggaugugcugcaucaucacggccagcauccugcucugguacgcgcagauccagccgcacuggaucgccgccuccaucauccuggaguucuuccugaucgugcuccugauccccgagcccgagaagcagcggacgccccaggacaaccagcugaccuacguggucaucgccauccucaccgugguggccgcgacgauggccaacgagaugggcuuccuggagaagaccaagaaggaccuggggcucggcagcaucaccacccaggagagcgaguccaacauccuggacaucgaccugcgcccggccagcgccuggacgcucuacgccgucgcgaccaccuucgugacccccaugcugcggcacuccaucgagaacagcuccgugaacgucagccugacggccaucgccaaccaggccaccgugcucaugggccuggggaagggcuggccccuguccaagauggacaucggggugccccuccuggcgaucggcugcuacagccaggucaacccgaucacccugaccgccgcccuccugcugcucguggcccacuacgccaucaucgggcccggccugcaggcgaaggccacgcgcgaggcccagaagcgggccgccgcgggcaucaugaagaaccccaccguggacgggaucaccgucaucgaccuggagcccaucccguacgaccccaaguucgagaagcagcucggccaggugaugcugcugauccucugcgugacccagguccugaugaugcgcacgaccugggcccugugcgaggcccucacccuggccaccgggcccaucuccacgcugugggagggcaaccccgggcgguucuggaacaccaccaucgccgugagcauggcgaacaucuuccgcggcuccuaccucgccggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgcgaaggaggggaucaagcgcggcgagaccgaccaccacgccgucucccgggggagcgccaagcugcgcugguucguggagcggaacauggugaccccggagggcaaggucguggaccugggcugcgggcgcggcgggugguccuacuacugcggcgggcucaagaacgugcgggaggucaagggccugaccaagggcgggcccggccacgaggagcccauccccaugagcacguacggguggaaccuggugcgccuccagagcggcguggacgucuucuucaccccgcccgagaagugcgacacccugcugugcgacaucggggaguccagccccaaccccaccaucgaggccggccggacccuccgcgugcugaaccugguggagaacuggcucaacaacaacacgcaguucugcaucaagguccugaacccguacaugcccuccgugaucgagaagauggaggcccugcagcggcaguacggcggggcgcucgugcgcaacccccugagccggaacuccacccacgagauguacugggucagcaacgccaccggcaacaucguguccagcgugaacaugaucucccgcaugcugaucaaccgguucaccaugaagcacaagaaggccacguacgagccggacgucgaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggugaacggcgugguccgccugcugaccaagcccugggacguggugccgauggucacccagauggcgaugaccgacacgacccccuucgggcagcagcgcguguucaaggagaagguggacacccggacccaggagcccaaggagggcacgaagaagcucaugaagaucaccgccgaguggcuguggaaggagcugggcaagaagaagacgccccgcaugugcacccgggaggaguucacgaagaagguccgcuccaacgccgcccucggggccaucuucaccgacgagaacaaguggaaguccgcgcgggaggccguggaggacggccgcuucugggagcugguggaccgggagcgcaaccugcaccucgaggggaagugcgagaccugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgucgggaagaaggagggcggggccauguacgccgacgacaccgccggcugggacacgcggaucacccuggaggaccugaagaacgaggagauggugaccaaccacaugaagggggagcacaagaagcucgcggaggccaucuucaagcugaccuaccagaacaaggugguccgcgugcagcggccgacgccccgcggcaccgugauggacaucaucagccggcgcgaccagcggggcuccgggcaggucggcaccuacgggcugaacaccuucacgaacauggaggcccagcucauccgccagauggagggcgagggcaucuucaagagcauccagcaccugaccgccaccgaggagaucgccgugcagaacuggcuggcgcgcguggggcgggagcgccucucccggauggccaucagcggcgacgacugcgucgugaagcccaucgacgaccgcuucgccuccgcccugaccgcccugaacgacauggggaaggugcggaaggacauccagcagugggagcccagccgcggcuggaacgacuggacgcaggucccguucugcucccaccacuuccacgagcucgugaugaaggacgggcgggugcuggucgugcccugccgcaaccaggacgagcugaucggccgggcgcgcaucagccagggcgccggguggucccucaaggagaccgccugccugggcaagagcuacgcccagauguggacccugauguacuuccaccggcgcgaccuccggcuggccgcgaacgccaucugcuccgccgugcccagccacuggguccccaccucccgcaccacguggagcauccacgccaagcacgaguggaugaccaccgaggacaugcuggcgguguggaaccggguguggauccaggagaacccguggauggaggacaagacccccgucgaguccugggaggaggugcccuaccucgggaagcgcgaggaccaguggugcggcagccugaucgggcugacgagccgggccaccugggccaagaacauccagaccgccaucaaccaggugcgcucccucaucggcaacgaggaguacaccgacuacaugcccagcaugaagcgguuccgccgcgaggaggaggaggccggcguccugugguga

SEQ ID NO: 9203 - RNA, 9876 nt, Artificial Sequence
  derived and/or modified CDS sequence (opt1) from DENV-2__EU596495__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccucuucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccggcaaggacagccccgugaacaucgaggcggagccgcccuucggggacuccuacaucaucaucggcguggagccggggcagcugaagcucaacugguucaagaagggcagcuccaucggccagauguucgagacgaccaugcgcggggccaagcggauggccauccugggcgacaccgccugggacuucgggagccugggcggggucuucaccuccaucggcaaggcccuccaccagguguucggcgcgaucuacggggccgccuucagcggcguguccuggacgaugaagauccugaucggggucaucaucaccuggaucggcaugaacagccgcuccaccagccuguccgugagccuggugcucgucgggguggugacccuguaccugggcgccgucgugcaggcggacuccggcugcguggucagcuggaagaacaaggagcucaagugcggguccggcaucuucaucacggacaacgugcacaccuggaccgagcaguacaaguuccagcccgagagccccagcaagcuggccuccgccauccagaaggcccacgaggaggggaucugcggcauccggagcgugacccgccuggagaaccucauguggaagcagaucacgcccgagcugaaccacauccuguccgagaacgaggucaagcucaccaucaugaccggggacaucaagggcaucaugcaggccggcaagcggagccugcgcccgcagcccaccgagcugaaguacuccuggaagacgugggggaaggcgaagaugcucagcaccgagucccacaaccagaccuuccugaucgacggccccgagaccgccgagugcccgaacacgaaccgggccuggaacagccuggagguggaggacuacggguucggcguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacgggguccuggagagcgagaugaucauccccaagaacuucgccggccccgugucccagcacaacuaccgcccgggguaccacacgcagaccgcgggccccuggcaccucgggaagcuggagauggacuucgacuucugcgagggcaccaccguggucgugacggaggacugcggcaaccgggggcccagccugcgcaccaccaccgccagcggcaagcucaucacggaguggugcugccgguccugcacccugcccccgcugcgcuaccgcggggaggacggcugcugguacgggauggagauccgcccccucaaggagaaggaggagaaccuggugaacagccuggucaccgccggccacggccagaucgacaacuucucccucggggugcugggcauggcccuguuccucgaggagaugcugcggacccgcaucgggacgaagcacgcgauccugcucguggccgucagcuucgugacccugaucaccggcaacauguccuuccgggaccuggggcgcgugauggucauggugggcgccaccaugacggacgacaucggcaugggggugaccuaccucgcccugcuggccgcguucaagguccgccccaccuucgccgccggccuccugcugcggaagcucaccagcaaggagcugaugauggccacgaucgggaucgcccugcucucccagagcaccauccccgagaccauccuggagcugaccgacgcgcucgcccugggcaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccguggggauggugagcauccucgccuccagccugcugaagaacgacauccccaugacgggcccccucgucgccggcgggcugcugaccgugugcuacgugcucaccgggcggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccgggcuccuggugaucagcggcguguucccggucuccauccccaucaccgcggccgccugguaccugugggaggugaagaagcagcgcgccggggugcucugggacguccccagcccgccgcccguggagaaggccgagcuggaggacggcgcguaccggaucaagcagcgcgggauccugggcuacucccagaucggcgccgggguguacaaggagggcaccuuccacacgauguggcacgucacccgcggggcggugcucaugcaccggggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgcggugcagaccaagcccggcaucuucaagaccaacacggggaccaucggcgccgucagccuggacuucucccccggcaccagcgggucccccaucguggaccggaagggcaagguggucgggcucuacggcaacggcguggugacccgcagcggggccuacgucuccgccaucgcgcagacggagaaguccaucgaggacaaccccgagaucgaggacgacaucuuccggaagaagcgccugaccaucauggaccugcaccccggcgccgggaagaccaagcgguaccuccccgccaucgugcgcgaggccaucaagcggggccugcgcacccugauccuggccccgacgcgcguggucgcggccgagauggaggaggcccuccgggggcugcccauccgcuaccagacccccgccaucaagaccgagcacaccggccgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggggaggccgcgggcaucuucaugacggccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccuccggaagaacggcaagaaggugauccagcugagccgcaagacguucgacuccgaguacgucaagacccgggccaacgacugggacuucguggugaccaccgacaucagcgagaugggggccaacuucaaggccgagcgcgucaucgacccccggcgcugcaugaagcccgugauccugacggacggcgaggagcgggugauccucgcggggcccaugccggucacccacuccagcgccgcccagcgccggggccgcaucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaagguggacgcgaucgacggggaguaccgccugcggggcgaggcccgcaagaccuucguggaccugaugcggcgcggggaccuccccgucuggcuggccuacaagguggccgccgagggcaucaacuacgcggaccggaaguggugcuucgacgggaucaagaacaaccagauccuggaggagaacauggagguggagaucuggacgaaggagggcgagcgcaagaagcucaagccgcgguggcuggacgcccgcaucuacagcgacccccuggcccucaaggaguucaaggaguucgccgcgggccggaagucccugacccugaaccucaucaccgagauggggcgccugcccaccuucaugacgcagaaggcccggaacgcccuggacaaccucgccguccugcacaccgccgaggcgggcgggcgcgccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggguuccuggagaagacgaagaaggaccugggccucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucauggggcugggcaagggguggccccuguccaagauggacaucggcgugccccuccuggcgaucgggugcuacagccaggugaacccgaucacccugaccgccgcccuccugcugcucgucgcccacuacgccaucaucggccccggccugcaggcgaaggccacccgcgaggcccagaagcgggccgccgcggggaucaugaagaaccccacgguggacggcaucaccgugaucgaccuggagcccaucccguacgaccccaaguucgagaagcagcucgggcaggucaugcugcugauccucugcgugacccaggugcugaugaugcgcaccacgugggcccugugcgaggcccucacccuggccaccggccccaucuccacccugugggaggggaaccccggccgguucuggaacacgaccaucgccgucagcauggcgaacaucuuccgcggcuccuaccucgccggggccggccugcuguucagcaucaugaagaacaccaccuccacgcgccgggggaccggcaacaucggcgagacccucggggagaaguggaagucccgccugaacgcccugggcaaguccgaguuccagaucuacaagaaguccgggauccaggagguggaccggacccucgcgaaggagggcaucaagcgcggggagacggaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugaccaagggcgggcccgggcacgaggagcccauccccaugagcaccuacggcuggaaccugguccgccuccagagcgggguggacguguucuucacgccgcccgagaagugcgacacccugcugugcgacaucggcgaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacgggggcgcgcucgugcgcaacccccugagccggaacuccacgcacgagauguacugggugagcaacgccaccgggaacaucgucuccagcgugaacaugaucucccgcaugcugaucaaccgguucaccaugaagcacaagaaggccaccuacgagccggacguggaccugggcagcgggacgcgcaacaucggcaucgaguccgagauccccaaccucgacaucaucggcaagcggaucgagaagaucaagcaggagcacgagaucagcuggcacuacgaccaggaccaccccuacaagaccugggccuaccacggguccuacgagaccaagcagaccggcagcgccuccagcauggucaacgggguggugcgccugcugacgaagcccugggacgucgugccgauggugacccagauggcgaugaccgacaccacgcccuucggccagcagcgcgucuucaaggagaagguggacacccggacccaggagcccaaggagggcaccaagaagcucaugaagaucacggccgaguggcuguggaaggagcuggggaagaagaagacgccccgcaugugcacccgggaggaguucaccaagaaggugcgcuccaacgccgcccucggcgccaucuucacggacgagaacaaguggaaguccgcgcgggaggccgucgaggacgggcgcuucugggagcugguggaccgggagcgcaaccugcaccucgagggcaagugcgagaccugcguguacaacaugauggggaagcgggagaagaagcugggcgaguucggcaaggccaaggggucccgcgccaucugguacauguggcugggcgcgcgguuccucgaguucgaggcccugggguuccugaacgaggaccacugguucagccgcggcaacagccucuccggggucgagggcgagggccugcaccggcugggguacauccuccgcgacgugggcaagaaggagggcggggccauguacgccgacgacaccgccgggugggacacccggaucacgcuggaggaccugaagaacgaggagauggucaccaaccacaugaagggcgagcacaagaagcucgcggaggccaucuucaagcugaccuaccagaacaagguggugcgcguccagcggccgacgccccgcggcacggugauggacaucaucagccggcgcgaccagcggggguccggccagguggggaccuacggccugaacaccuucaccaacauggaggcccagcucauccgccagauggagggcgaggggaucuucaagagcauccagcaccugacggccaccgaggagaucgccguccagaacuggcuggcgcgcgugggccgggagcgccucucccggauggccaucagcggggacgacugcguggucaagcccaucgacgaccgcuucgccuccgcccugaccgcccugaacgacaugggcaaggugcggaaggacauccagcagugggagcccagccgcggguggaacgacuggacccaggugccguucugcucccaccacuuccacgagcucgucaugaaggacggccgggugcuggugguccccugccgcaaccaggacgagcugaucggccgggcgcgcaucagccagggggccggcuggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucggcaagcgcgaggaccaguggugcgggagccugaucggccugaccagccgggccacgugggccaagaacauccagaccgccaucaaccaggugcgcucccucaucggcaacgaggaguacaccgacuacaugcccagcaugaagcgguuccgccgcgaggaggaggaggccggggugcugugguga

SEQ ID NO: 9204 - RNA, 9876 nt, Artificial Sequence
  derived and/or modified CDS sequence (opt1) from DENV-2__EU596497__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaucaccgagucccggugcccgacccagggcgagcccagccugaacgaggagcaggacaagcgcuucaucugcaagcacuccaugguggaccggggcugggggaacggcugcgggcuguucggcaagggcgggaucgucacgugcgcgauguucacgugcaagaagaacauggagggcaagguggugcagcccgagaaccuggaguacaccaucgucaucacgccccacagcggggaggagcacgccgugggcaacgacacggggaagcacggcaaggagaucaagaucaccccgcaguccagcaucaccgaggccgagcugaccggguacggcaccgugacgauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgccgagacccagcacgggaccaucgugauccgcguccaguacgagggcgacggcucccccugcaagauccccuucgagaucacggaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagcuacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacaccauguggcacgucacgcggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacaccggcacgaucggggccgucagccuggacuucucccccggcaccagcggcucccccaucguggaccggaaggggaagguggucggccucuacgggaacggcguggugacccgcagcggcgccuacgucuccgccaucgcgcagaccgagaaguccaucgaggacaaccccgagaucgaggacgacaucuuccggaagaagcgccugacgaucauggaccugcaccccggggccggcaagaccaagcgguaccuccccgccaucgugcgcgaggccaucaagcgggggcugcgcacccugauccuggccccgacccgcguggucgcggccgagauggaggaggcccuccggggccugcccauccgcuaccagacgcccgccaucaagaccgagcacaccgggcgggagaucguggaccugaugugccacgccaccuucacgaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggggaggagcgggugauccucgcgggccccaugccggucacgcacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacgcugaaccucaucaccgagaugggccgccugcccaccuucaugacccagaaggcccggaacgcccuggacaaccucgccguccugcacacggccgaggccgggggccgcgccuacaaccacgcccugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugacguacguggugaucgccauccucaccgucguggccgcgaccauggccaacgagaugggcuuccuggagaagaccaagaaggaccuggggcucggcagcaucacgacccaggagagcgaguccaacauccuggacaucgaccugcgcccggccagcgccuggacccucuacgccguggcgaccacguucgucacccccaugcugcggcacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacgcugaccgccgcccuccugcugcucgucgcccacuacgccaucaucgggcccggccugcaggcgaaggccacccgcgaggcccagaagcgggccgccgcgggcaucaugaagaaccccaccguggacgggaucacggugaucgaccuggagcccaucccguacgaccccaaguucgagaagcagcucggccaggucaugcugcugauccucugcgugacccaggugcugaugaugcgcaccaccugggcccugugcgaggcccucacgcuggccaccgggcccaucuccacccugugggagggcaaccccgggcgguucuggaacaccacgaucgccgucagcauggcgaacaucuuccgcggcuccuaccucgccggcgccgggcugcuguucagcaucaugaagaacaccaccuccacccgccggggcacggggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagaccgaccaccacgccgugucccgggggagcgccaagcugcgcugguucgucgagcggaacauggugacgccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucaccccgcccgagaagugcgacacgcugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacccacgagauguacugggugagcaacgccacgggcaacaucgucuccagcgugaacaugaucucccgcaugcugaucaaccgguucaccaugaagcacaagaaggccaccuacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccugcugaccaagcccugggacgucgugccgauggugacgcagauggcgaugaccgacaccacccccuucgggcagcagcgcgucuucaaggagaagguggacacgcggacccaggagcccaaggagggcaccaagaagcucaugaagaucaccgccgaguggcuguggaaggagcugggcaagaagaagacgccccgcaugugcacccgggaggaguucaccaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagacgugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacccuggaggaccugaagaacgaggagauggucacgaaccacaugaagggggagcacaagaagcucgcggaggccaucuucaagcugaccuaccagaacaagguggugcgcguccagcggccgacgccccgcggcaccgugauggacaucaucagccggcgcgaccagcggggcuccggccaggugggcacguacgggcugaacaccuucaccaacauggaggcccagcucauccgccagauggagggcgagggcaucuucaagagcauccagcaccugaccgccacggaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacgcugauguacuuccaccggcgcgaccuccggcuggccgcgaacgccaucugcuccgccgugcccagccacugggugcccaccucccgcaccaccuggagcauccacgccaagcacgaguggaugaccacggaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccaccugggccaagaacauccagacggccaucaaccaggugcgcucccucaucggcaacgaggaguacaccgacuacaugcccagcaugaagcgguuccgccgcgaggaggaggaggccggcgugcugugguga

SEQ ID NO: 9205 - RNA, 9876 nt, Artificial Sequence
  derived and/or modified CDS sequence (opt1) from DENV-2__EU569695__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccgucgccaaccaggccacggugcucaugggccuggggaagggcuggccccuguccaagauggacaucggggugccccuccuggcgaucggcugcuacagccaggucaacccgaucacccugaccgccgcccuccugcugcucguggcccacuacgccaucaucgggcccggccugcaggcgaaggccacccgcgaggcccagaagcgggccgccgcgggcaucaugaagaaccccacgguggacgggaucaccgucaucgaccuggagcccaucccguacgaccccaaguucgagaagcagcucggccaggugaugcugcugauccucugcgugacccagguccugaugaugcgcaccacgugggcccugugcgaggcccucacccuggccaccgggcccaucuccacccugugggagggcaaccccgggcgguucuggaacacgaccaucgccgugagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgucucccgggggagcgccaagcugcgcugguucguggagcggaacauggugaccccggagggcaaggucguggaccugggcugcgggcgcggcgggugguccuacuacugcggcgggcucaagaacgugcgggaggucaagggccugaccaagggcgggcccggccacgaggagcccauccccaugagcaccuacggguggaaccuggugcgccuccagagcggcguggacgucuucuucacgccgcccgagaagugcgacacccugcugugcgacaucggggaguccagccccaaccccaccaucgaggccggccggacccuccgcgugcugaaccugguggagaacuggcucaacaacaacacccaguucugcaucaagguccugaacccguacaugcccuccgugaucgagaagauggaggcccugcagcggcaguacggcggggcgcucgugcgcaacccccugagccggaacuccacgcacgagauguacugggucagcaacgccaccggcaacaucguguccagcgugaacaugaucucccgcaugcugaucaaccgguucaccaugaagcacaagaaggccaccuacgagccggacgucgaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggugaacggcgugguccgccugcugacgaagcccugggacguggugccgauggucacccagauggcgaugaccgacaccacgcccuucgggcagcagcgcguguucaaggagaagguggacacccggacccaggagcccaaggagggcaccaagaagcucaugaagaucacggccgaguggcuguggaaggagcugggcaagaagaagacgccccgcaugugcacccgggaggaguucaccaagaagguccgcuccaacgccgcccucggggccaucuucacggacgagaacaaguggaaguccgcgcgggaggccguggaggacggccgcuucugggagcugguggaccgggagcgcaaccugcaccucgaggggaagugcgagaccugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgucgggaagaaggagggcggggccauguacgccgacgacaccgccggcugggacacccggaucacgcuggaggaccugaagaacgaggagauggugaccaaccacaugaagggggagcacaagaagcucgcggaggccaucuucaagcugaccuaccagaacaaggugguccgcgugcagcggccgacgccccgcggcacggugauggacaucaucagccggcgcgaccagcggggcuccgggcaggucggcaccuacgggcugaacaccuucaccaacauggaggcccagcucauccgccagauggagggcgagggcaucuucaagagcauccagcaccugacggccaccgaggagaucgccgugcagaacuggcuggcgcgcguggggcgggagcgccucucccggauggccaucagcggcgacgacugcgucgugaagcccaucgacgaccgcuucgccuccgcccugaccgcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacuggguccccaccucccgcaccaccuggagcauccacgccaagcacgaguggaugacgaccgaggacaugcuggcgguguggaaccggguguggauccaggagaacccguggauggaggacaagacccccgucgaguccugggaggaggugcccuaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccggcguccugugguga

SEQ ID NO: 9206 - RNA, 9876 nt, Artificial Sequence
  derived and/or modified CDS sequence (opt1) from DENV-2__EU482623__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccaggagagcaacuggauccagaaggagacgcuggugaccuucaagaacccccacgcgaagaagcaggacgucgugguccucggcucccaggagggggccaugcacaccgcccugaccggcgccacggagauccagaugagcagcgggaaccuccuguucaccggccaccugaagugccgccugcggauggacaagcuccagcugaagggcauguccuacagcaugugcaccgggaaguucaagaucgugaaggagaucgccgagacccagcacggcacgaucgugauccgcguccaguacgagggggacggcucccccugcaagauccccuucgagaucaccgaccuggagaagcggcacgugcucggccgccugaucaccgugaacccgaucgucaccgagaaggacagccccgugaacaucgaggcggagccgcccuucggggacuccuacaucaucaucggcguggagccggggcagcugaagcucaacugguucaagaagggcagcuccaucgggcagauguucgagacgaccaugcgcggcgccaagcggauggccauccugggcgacaccgccugggacuucgggagccugggcggggucuucaccuccaucggcaaggcccuccaccagguguucggggcgaucuacggcgccgccuucagcggcguguccuggacgaugaagauccugaucggggucaucaucaccuggaucggcaugaacagccgcuccaccagccuguccgugagccuggugcucgucgggguggugacccuguaccugggcgccgucgugcaggcggacuccgggugcguggucagcuggaagaacaaggagcucaagugcggcuccggcaucuucaucacggacaacgugcacaccuggaccgagcaguacaaguuccagcccgagagccccagcaagcuggccuccgccauccagaaggcccacgaggaggggaucugcggcauccggagcgugacccgccuggagaaccucauguggaagcagaucacgcccgagcugaaccacauccuguccgagaacgaggucaagcucaccaucaugaccggggacaucaagggcaucaugcaggccgggaagcggagccugcgcccgcagcccaccgagcugaaguacuccuggaagacguggggcaaggcgaagaugcucagcaccgagucccacaaccagaccuuccugaucgacggccccgagaccgccgagugcccgaacacgaaccgggccuggaacagccuggagguggaggacuacggguucggcguguucaccaccaacaucuggcucaagcugcgcgagaagcaggacgucuucugcgacuccaagcugaugagcgccgccaucaaggacaaccgggcggugcacgccgacaugggguacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccggccccgugucccagcacaacuaccgcccgggguaccacacgcagaccgcgggccccuggcaccucgggaagcuggagauggacuucgacuucugcgagggcaccaccguggucgugacggaggacugcgggaaccggggccccagccugcgcaccaccaccgccagcggcaagcucaucacggaguggugcugccgguccugcacccugcccccgcugcgcuaccgcggggaggacggcugcugguacgggauggagauccgcccccucaaggagaaggaggagaaccuggugaacagccuggucaccgccggccacgggcagaucgacaacuucucccucggcgugcugggcauggcccugcuccuggaggagaugcugcggacccgcaucgggacgaagcacgcgauccuccugguggccgucagcuucgugacccugaucaccggcaacauguccuuccgggaccucgggcgcgugauggucauggugggcgccaccaugacggacgacaucgggaugggcgugaccuaccuggcccugcucgccgcguucaagguccgccccaccuucgccgccggccugcugcuccggaagcugaccagcaaggagcugaugauggccacgaucgggaucgcccuccugucccagagcaccauccccgagaccauccuggagcucaccgacgcgcuggcccugggcaugauggugcucaagaucgugcgcaacauggagaaguaccagcuggccgucacgaucauggccaucuccugcgugccgaacgccgugauccugcagaacgcguggaaggucagcugcaccauccucgccgccguguccgucagcccccugcugcucaccuccagccagcagaaggccgacuggaucccccuggcgcugaccaucaaggggcucaaccccacggccaucuuccugaccacccugucccggaccagcaagaagcgcuccuggccgcucaacgaggccaucauggccgugggcauggugagcauccuggccuccagccugcucaagaacgacauccccaugacgggcccccuggucgccggcgggcugcucaccgugugcuacgugcugaccgggcggagcgccgaccuggagcucgagcgcgccgccgacgucaagugggaggaccaggccgagaucuccgggagcucccccauccugagcaucaccaucuccgaggacgggagcauguccaucaagaacgaggaggaggagcagacgcugaccauccucauccggaccggccugcuggugaucagcggcguguucccggucuccauccccaucaccgcggccgccugguaccucugggaggugaagaagcagcgcgccggggugcugugggacguccccagcccgccgcccguggagaaggccgagcuggaggacggcgcguaccggaucaagcagcgcgggauccucggcuacucccagaucggggccggcguguacaaggagggcaccuuccacacgauguggcacgucacccgcggggcggugcugaugcaccggggcaagcggaucgagcccagcugggccgacgugaagaaggaccugaucuccuacgggggcggguggaagcucgagggcgaguggaaggagggcgaggagguccaggugcuggcccuggagcccgggaagaacccccgcgcggugcagaccaagcccggcaucuucaagaccaacagcgggacgaucggcgccgucucccucgacuucagccccgggaccuccggcagccccaucguggaccggaagggcaagguggucgggcuguacggcaacgggguggugacccgcuccggcgccuacgucagcgccaucgcgcagaccgagaaguccaucgaggacaaccccgagaucgaggacgacaucuuccggaagaagcgccugacgaucauggaccuccaccccggcgccgggaagaccaagcgguaccugcccgccaucgugcgcgaggccaucaagcggggccugcgcacccugauccucgccccgacccgcguggucgcggccgagauggaggaggcccugcgggggcugcccauccgcuaccagacgcccgccaucaagaccgagcacaccggccgggagaucguggaccucaugugccacgccaccuucacgaugcgccugcugucccccgugcgggucccgaacuacaaccucaucaucauggacgaggcgcacuucaccgaccccgccagcaucgccgcccgcggguacaucuccacccggguggagaugggcgaggccgcgggcaucuucaugaccgccacgccgcccgggagccgcgacccguucccccaguccaacgcccccaucauggacgaggagcgggagauccccgagcgcagcuggaacuccggccacgagugggugaccgacuucaaggggaagaccgucugguucgugccgagcaucaaggccggcaacgacaucgcggccugccugcggaagaacgggaagaaggugauccagcugucccgcaagaccuucgacagcgaguacgucaagacgcgggccaucgacugggacuucguggugaccaccgacaucuccgagaugggcgccaacuucaaggccgagcgcgucaucgacccccggcgcugcaugaagcccgugauccucaccgacggcgaggagcgggugauccuggcggggcccaugccggucacgcacagcuccgccgcccagcgccggggccgcaucgggcgcaaccccaagaacgagaacgaccaguacaucuacaugggcgagccccuggagaacgacgaggacugcgcccacuggaaggaggccaagaugcuccuggacaacaucaacacccccgaggggaucaucccgagcauguucgagcccgagcgggagaagguggacgcgaucgacggcgaguaccgccugcggggcgaggcccgcaagaccuucguggaccucaugcggcgcggggaccugcccgucuggcuggccuacaagguggccgccgagggcaucaacuacgcggaccggaaguggugcuucgacgggaucaagaacaaccagauccucgaggagaacauggagguggagaucuggaccaaggagggcgagcgcaagaagcugaagccgcgguggcuggacgcccgcaucuacuccgacccccucgcccugaaggaguucaaggaguucgccgcggggcgcaagagccugacgcucaaccugaucaccgagaugggccgccugcccaccuucaugacccagaaggcccggaacgcccucgacaaccuggccguccugcacacggccgaggcgggcgggcgcgccuacaaccacgcccucuccgagcugcccgagacccuggagacccuccugcugcucacccugcuggccacggugaccggcgggaucuuccucuuccugaugagcggcaagggcaucgggaagaugacccugggcaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggguuccuggagaagaccaagaaggaccucggccuggggagcaucacgacccaggaguccgagagcaacauccuggacaucgaccuccgcccggccuccgccuggacccuguacgccguggcgaccacguucgucacccccaugcugcggcacagcaucgagaacuccagcgugaacgugucccucaccgccaucgccaaccaggccaccguccugaugggccugggcaagggguggccccucagcaagauggacaucggcgugccccugcuggcgaucgggugcuacucccaggugaacccgaucacgcucaccgccgcccugcugcuccuggucgcccacuacgccaucaucggccccgggcugcaggcgaaggccacccgcgaggcccagaagcgggccgccgcgggcaucaugaagaaccccaccguggacggcaucacggugaucgaccucgagcccaucccguacgaccccaaguucgagaagcagcuggggcaggucaugcugcucauccugugcgugacccaggugcugaugaugcgcaccaccugggcccucugcgaggcccugacgcuggccaccggccccaucagcacccucugggaggggaaccccggccgguucuggaacaccacgaucgccgucuccauggcgaacaucuuccgcgggagcuaccuggccggcgccggccuccucuucuccaucaugaagaacaccaccagcacccgccgggggacgggcaacaucggggagacccugggcgagaaguggaagucccgccugaacgcccucggcaagagcgaguuccagaucuacaagaaguccgggauccaggagguggaccggacccuggcgaaggagggcaucaagcgcggggagaccgaccaccacgccgugagccggggcuccgccaagcugcgcugguucgucgagcggaacauggugacgccggaggggaagguggucgaccucggcugcggccgcgggggcuggagcuacuacugcgggggccugaagaacgugcgggaggugaaggggcugaccaagggcggccccgggcacgaggagcccauccccaugagcaccuacggcuggaaccucguccgccugcaguccgggguggacguguucuucaccccgcccgagaagugcgacacgcugcucugcgacaucggcgagagcucccccaaccccaccaucgaggccgggcggacccugcgcguccugaaccucguggagaacuggcugaacaacaacacccaguucugcaucaaggugcugaacccguacaugcccagcgucaucgagaagauggaggcccuccagcggcaguacggcggcgcgcuggugcgcaacccccugucccggaacagcacccacgagauguacuggguguccaacgccacggggaacaucgucagcuccgugaacaugaucagccgcaugcugaucaaccgguucaccaugaagcacaagaaggccaccuacgagccggacguggaccucggcuccgggacccgcaacaucggcaucgagagcgagauccccaaccuggacaucaucgggaagcggaucgagaagaucaagcaggagcacgagaucuccuggcacuacgaccaggaccaccccuacaagacgugggccuaccacggcagcuacgagaccaagcagaccggcuccgccagcuccauggucaacgggguggugcgccugcucaccaagcccugggacgucgugccgauggugacgcagauggcgaugaccgacaccacccccuucggccagcagcgcgucuucaaggagaagguggacacgcggacccaggagcccaaggaggggaccaagaagcugaugaagaucaccgccgaguggcuguggaaggagcucggcaagaagaagacgccccgcaugugcacccgggaggaguucaccaagaaggugcgcagcaacgccgcccugggcgccaucuucaccgacgagaacaaguggaaguccgcgcgggaggccgucgaggacgggcgcuucugggagcugguggaccgggagcgcaaccuccaccuggagggcaagugcgagacgugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucagccgcggcaacucccugagcggggucgagggcgaggggcugcaccggcucggcuacauccugcgcgacgugggcaagaaggagggcggcgccauguacgccgacgacaccgccgggugggacacccggaucacccuggaggaccucaagaacgaggagauggucacgaaccacaugaagggcgagcacaagaagcuggcggaggccaucuucaagcugaccuaccagaacaagguggugcgcguccagcggccgacgccccgggggaccgugauggacaucaucucccggcgcgaccagcggggcagcggccagguggggacguacggccucaacaccuucaccaacauggaggcccagcugauccgccagauggagggggagggcaucuucaaguccauccagcaccugaccgccacggaggagaucgccguccagaacuggcucgcgcgcgugggccgggagcgccugagccggauggccaucuccggggacgacugcguggucaagcccaucgacgaccgcuucgccagcgcccugaccgcccucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucgggcgggcgcgcaucucccagggcgccggcuggagccugaaggagaccgccugccuggggaaguccuacgcccagauguggacgcucauguacuuccaccggcgcgaccugcggcuggccgcgaacgccaucugcagcgccgugcccucccacugggugcccaccagccgcaccaccugguccauccacgccaagcacgaguggaugaccacggaggacaugcucgcggucuggaaccggguguggauccaggagaacccguggauggaggacaagacccccguggagagcugggaggagguccccuaccugggcaagcgcgaggaccaguggugcgggagccugaucggccucaccucccgggccaccugggccaagaacauccagacggccaucaaccaggugcgcagccugaucgggaacgaggaguacaccgacuacaugcccuccaugaagcgguuccgccgcgaggaggaggaggccggcgugcugugguga

SEQ ID NO: 9207 - RNA, 9876 nt, Artificial Sequence
  derived and/or modified CDS sequence (opt1) from DENV-2__EU569698__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacagcuucccgcaguccaacgcccccaucauggacgaggagcgggagauccccgagcgcagcuggaacuccgggcacgagugggugaccgacuucaagggcaagaccgucugguucgugcccagcaucaaggccgggaacgacaucgcggccugccuccggaagaacggcaagaaggugauccagcugucccgcaagacguucgacagcgaguacgucaagacccgggccaacgacugggacuucguggugaccaccgacaucuccgagaugggcgccaacuucaaggccgagcgcgucaucgacccgcggcgcugcaugaagcccgugauccugacggacggggaggagcgggugauccucgcgggccccaugcccgucacccacagcuccgccgcccagcgccgggggcgcaucggccgcaacccgaagaacgagaacgaccaguacaucuacaugggggagccccuggagaacgacgaggacugcgcccacuggaaggaggccaagaugcugcucgacaacaucaacacccccgagggcaucauccccagcauguucgagccggagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccccgguggcuggacgcccgcaucuacuccgacccgcuggcccucaaggaguucaaggaguucgccgcgggccgcaagagccugacccugaaccucaucaccgagaugggccgccugcccaccuucaugacgcagaaggcccggaacgcccuggacaaccucgccguccugcacaccgccgaggccgggggccgcgccuacaaccacgcccuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcgcagauccagccccacuggaucgccgccagcaucauccuggaguucuuccugaucguccuccugaucccggagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggaguccgagagcaacauccuggacaucgaccugcgccccgccuccgccuggacccucuacgccguggcgacgaccuucgucaccccgaugcugcggcacagcaucgagaacuccagcgugaacgugucccugaccgccaucgccaaccaggccacgguccucaugggccuggggaagggcuggccccugagcaagauggacaucggggugccccuccuggcgaucggcugcuacucccaggugaaccccaucacccugaccgccgcccuccugcugcucgucgcccacuacgccaucaucgggccgggccugcaggcgaaggccacccgcgaggcccagaagcgggccgccgcgggcaucaugaagaaccccacgguggacgggaucaccgugaucgaccuggagcccauccccuacgacccgaaguucgagaagcagcucggccaggucaugcugcugauccucugcgugacccaggugcugaugaugcgcaccacgugggcccugugcgaggcccucacccuggccaccgggcccaucagcacccugugggagggcaaccccgggcgguucuggaacacgaccaucgccgucuccauggcgaacaucuuccgcggcagcuaccucgccggcgccgggcugcuguucuccaucaugaagaacaccaccagcacgcgccggggcaccgggaacaucggcgagacccucggcgagaaguggaagucccgccugaacgcccugggcaagagcgaguuccagaucuacaagaaguccggcauccaggagguggaccggacccucgcgaaggaggggaucaagcgcggcgagacggaccaccacgccgugagccggggguccgccaagcugcgcugguucgucgagcggaacauggugacccccgagggcaagguggucgaccugggcugcgggcgcggcggguggagcuacuacugcggcgggcucaagaacgugcgggaggugaagggccugaccaagggcgggccgggccacgaggagcccauccccaugagcaccuacggguggaaccugguccgccuccaguccggcguggacguguucuucacgcccccggagaagugcgacacccugcugugcgacaucggggagagcucccccaaccccaccaucgaggccggccggacccuccgcguccugaaccugguggagaacuggcucaacaacaacacccaguucugcaucaaggugcugaaccccuacaugccgagcgucaucgagaagauggaggcccugcagcggcaguacggcggggcgcucgugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagcccgacguggaccugggguccggcacgcgcaacaucgggaucgagagcgagaucccgaaccucgacaucaucggcaagcggaucgagaagaucaagcaggagcacgagaucuccuggcacuacgaccaggaccaccccuacaagaccugggccuaccacggcagcuacgagaccaagcagaccggguccgccagcuccauggucaacggcguggugcgccugcugacgaagcccugggacgucgugcccauggugacccagauggcgaugaccgacaccacgccguucgggcagcagcgcgucuucaaggagaagguggacacccggacccaggagcccaaggagggcaccaagaagcucaugaagaucacggccgaguggcuguggaaggagcugggcaagaagaagacgccccggaugugcacccgggaggaguucaccaagaaggugcgcagcaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucagccgcgggaacucccucagcggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggcccaccccgcgcggcacggugauggacaucaucucccggcgcgaccagcggggcagcgggcaggucggcaccuacgggcugaacaccuucaccaacauggaggcccagcucauccgccagauggagggcgagggcaucuucaaguccauccagcaccugacggccaccgaggagaucgccguccagaacuggcuggcgcgcguggggcgggagcgccucagccggauggccaucuccggcgacgacugcguggucaagcccaucgacgaccgcuucgccagcgcccugaccgcccugaacgacauggggaaggugcggaaggacauccagcagugggagcccucccgcggcuggaacgacuggacccaggugcccuucugcagccaccacuuccacgagcucgucaugaaggacgggcgggugcugguggucccgugccgcaaccaggacgagcugaucggccgggcgcgcaucucccagggcgccggguggagccucaaggagacggccugccugggcaaguccuacgcccagauguggacccugauguacuuccaccggcgcgaccuccggcuggccgcgaacgccaucugcagcgccgugcccucccacugggugcccaccagccgcaccaccugguccauccacgccaagcacgaguggaugacgaccgaggacaugcuggcggucuggaaccggguguggauccaggagaaccccuggauggaggacaagaccccgguggagagcugggaggagguccccuaccucgggaagcgcgaggaccaguggugcggcagccugaucgggcugaccucccgggccacgugggccaagaacauccagaccgccaucaaccaggugcgcagccucaucggcaacgaggaguacaccgacuacaugcccuccaugaagcgguuccgccgcgaggaggaggaggccggcgugcugugguga

SEQ ID NO: 9208 - RNA, 9876 nt, Artificial Sequence
  derived and/or modified CDS sequence (opt1) from DENV-2__EU569699__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgaaguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggacaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccuccugcuggaggagaugcuccgcacccggaucggcacgaagcacgcgauccugcugguggccgugagcuucgucacccucaucaccgggaacauguccuuccgcgaccugggccgcgugauggugauggucggggccaccaugacggacgacaucggcaugggcgugaccuaccuggcccuccuggccgcguucaaggugcggcccaccuucgccgccgggcugcuccugcgcaagcugaccagcaaggagcucaugauggccacgaucggcaucgcccugcugucccagagcaccauccccgagaccauccucgagcugaccgacgcgcuggcccucgggaugaugguccugaagaucgugcggaacauggagaaguaccagcuggccgugacggucauggccaucuccugcgugccgaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccgcaccagcaagaagcgguccuggccgcugaacgaggccaucauggccgugggcauggugagcauccuggccuccagccuccugaagaacgacauccccaugacggggccccuggucgcgggcgggcuccugaccgugugcuacgugcugaccggccgcagcgccgaccucgagcuggagcgggccgccgacgucaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcgggguguucccggucuccauccccaucaccgcggccgccugguaccugugggaggugaagaagcagcgggccggcgugcugugggacguccccagcccgccgcccguggagaaggccgagcucgaggacggggcguaccgcaucaagcagcggggcauccugggguacucccagaucggcgccggcguguacaaggaggggaccuuccacacgauguggcacgucacccgcggcgccgugcugaugcaccgggggaagcgcaucgagcccagcugggccgacgugaagaaggaccucaucuccuacggcgggggcuggaagcuggagggcgaguggaaggagggggaggagguccaggugcuggcccucgagcccggcaagaacccccgggcggugcagaccaagcccgggaucuucaagaccaacacgggcaccaucggggccgucagccuggacuucucccccggcaccagcggcucccccaucguggaccgcaaggggaagguggucggccuguacgggaacggcguggugacccggagcggcgccuacgucuccgccaucgcgcagacggagaaguccaucgaggacaaccccgagaucgaggacgacaucuuccgcaagaagcggcucaccaucauggaccugcaccccggggccggcaagaccaagcgcuaccugcccgccaucgugcgggaggccaucaagcgcgggcugcgcacccucauccuggccccgacgcggguggucgcggccgagauggaggaggcccugcgcggccuccccauccgguaccagaccaccgccaucaagaccgagcacacggggcgcgagaucguggaccugaugugccacgccaccuucaccaugcggcugcucagccccgugcgcguccccaacuacaaccugaucaucauggacgaggcgcacuucaccgacccggccuccaucgccgcccggggcuacaucagcacgcgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggucugguucgugcccuccaucaaggccgggaacgacaucgcggccugccugcgcaagaacggcaagaaggugauccagcucagccggaagaccuucgacuccgaguacgucaagacccgcgccaacgacugggacuucguggugaccacggacaucagcgagaugggcgccaacuucaaggccgagcgggucaucgacccgcgccggugcaugaagcccgugauccugaccgacggggaggagcgcgugauccuggcgggccccaugcccgucacccacuccagcgccgcccagcggcgcgggcgcaucggccggaacccgaagaacgagaacgaccaguacaucuacaugggggagccccucgagaacgacgaggacugcgcccacuggaaggaggccaagaugcugcuggacaacaucaacacccccgagggcaucauccccuccauguucgagccggagcgcgagaagguggacgcgaucgacggcgaguaccggcuccgcggggaggcccggaagacguucguggaccugaugcgccggggcgaccugcccgucuggcucgccuacaagguggccgccgaggggaucaacuacgcggaccgcaaguggugcuucgacggcaucaagaacaaccagauccuggaggagaacauggagguggagaucuggaccaaggagggggagcggaagaagcugaagccccgcuggcucgacgcccggaucuacagcgacccgcuggcccugaaggaguucaaggaguucgccgcgggccgcaagucccucacccugaaccugaucaccgagaugggccggcuccccacguucaugacccagaaggcccgcaacgcccuggacaaccuggccguccuccacaccgccgaggccgggggccgggccuacaaccacgcccugagcgagcugcccgagacccucgagacgcugcugcuccugacccugcucgccaccgugaccgggggcaucuuccuguuccugauguccggcaaggggaucggcaagaugacccucgggaugugcugcaucaucacggccagcauccugcugugguacgcgcagauccagccccacuggaucgccgccuccaucauccucgaguucuuccugaucguccugcucaucccggagcccgagaagcagcgcacgccccaggacaaccagcugaccuacguggugaucgccauccugaccgucguggccgcgacgauggccaacgagaugggcuuccucgagaagaccaagaaggaccuggggcugggcagcaucaccacccaggagagcgaguccaacauccucgacaucgaccugcggcccgccagcgccuggacgcuguacgccguggcgaccaccuucgucaccccgaugcuccgccacuccaucgagaacagcuccgugaacgugagccugacggccaucgccaaccaggccaccguccugaugggccucgggaagggcuggccccuguccaagauggacaucggggugccccugcucgcgaucggcugcuacagccaggugaaccccaucacccugaccgccgcccugcuccugcuggucgcccacuacgccaucaucgggccgggccuccaggcgaaggccacgcgggaggcccagaagcgcgccgccgcgggcaucaugaagaaccccaccguggacgggaucaccgugaucgaccuggagcccauccccuacgacccgaaguucgagaagcagcugggccaggucaugcuccugauccugugcgugacccaggugcucaugaugcggacgaccugggcccugugcgaggcccugacccucgccaccgggcccaucuccacgcugugggagggcaaccccgggcgcuucuggaacaccaccaucgccgucagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcucaacgcccugggcaagagcgaguuccagaucuacaagaaguccggcauccaggagguggaccgcacgcuggcgaaggaggggaucaagcggggcgagaccgaccaccacgccgugagccgcggguccgccaagcuccggugguucgucgagcgcaacauggugacccccgagggcaagguggucgaccugggcugcgggcggggcggguggagcuacuacugcggcgggcugaagaacgugcgcgaggugaagggccucaccaagggcgggccgggccacgaggagcccauccccauguccacguacggguggaaccugguccggcugcagagcggcguggacguguucuucacgccgcccgagaagugcgacacccuccugugcgacaucggggagagcucccccaaccccaccaucgaggccggccgcacccugcggguccucaaccugguggagaacuggcugaacaacaacacgcaguucugcaucaaggugcucaaccccuacaugcccagcgucaucgagaagauggaggcccugcagcgcaaguacggcggggcgcuggugcggaacccccugucccgcaacagcacccacgagauguacuggguguccaacgccaccggcaacaucgucagcuccgugaacaugaucagccggaugcucaucaaccgcuucaccaugaagcacaagaaggccacguacgagcccgacguggaccugggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcgccuccugaccaagcccugggacgucgugcccauggugacccagauggcgaugacggacaccaccccguucgggcagcagcgggucuucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaaggugcgcagcaacgccgcccugggggccaucuucaccgacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcgucgagggggagggccuccaccggcugggcuacauccugcgcgacguggggaagaaggagggcggggccauguacgccgacgacacggccggcugggacacccggaucacccucgaggaccugaagaacgaggagauggucaccaaccacaugaagggggagcacaagaagcuggcggaggccaucuucaagcucacguaccagaacaagguggugcgcguccagcggcccaccccgcgcggcaccgugauggacaucaucucccggcgcgaccagcgcggcagcgggcaggucggcaccuacgggcugaacacguucaccaacauggaggcccagcugauccggcagauggagggcgagggcaucuucaaguccauccagcaccucaccgccaucgaggagaucgccguccagaacuggcuggcgcgcguggggcgggagcgccugagccggauggccaucuccggcgacgacugcgugaucaagcccaucgacgaccgcuucgccagcgcccucaccgcccugaacgacauggggaagguccggaaggacauccagcagugggagcccucccgcggcuggaacgacuggacccaggugcccuucugcagccaccacuuccacgagcuggugaugaaggacgggcggguccucguggugccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccguccccucccacugggugcccaccagccgcaccacgugguccauccacgccaagcacgaguggaugaccaccgaggacaugcuggcgguguggaaccgggucuggauccaggagaaccccuggauggaggacaagaccccgguggagagcugggaggaggugcccuaccuggggaagcgcgaggaccaguggugcggcucccucaucgggcugacgagccgggccaccugggccaagaacauccagaccgccaucaaccagguccgcagccugaucggcaacgaggaguacaccgacuacaugcccuccaugaagcgcuuccggcgcgaggaggaggaggccggcgugcucugguga

SEQ ID NO: 9209 - RNA, 9876 nt, Artificial Sequence
  derived and/or modified CDS sequence (opt1) from DENV-2__KF955366__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccaccucccccggcagccgcgaccccuucccgcaguccaacgcccccaucauggacgaggagcgggagauccccgagcgcagcuggaacuccgggcacgagugggugaccgacuucaagggcaagaccgucugguucgugcccagcaucaaggccgggaacgacaucgcggccugccuccggaagaacggcaagaaggugauccagcugucccgcaagacguucgacagcgaguacgucaagacccgggccaacgacugggacuucguggugaccaccgacaucuccgagaugggcgccaacuucaaggccgagcgcgucaucgacccgcggcgcugcaugaagcccgugauccugacggacggggaggagcgggugauccucgcgggccccaugcccgucacccacagcuccgccgcccagcgccgggggcgcaucggccgcaacccgaagaacgagaacgaccaguacaucuacaugggggagccccuggagaacgacgaggacugcgcccacuggaaggaggccaagaugcugcucgacaacaucaacacccccgagggcaucauccccagcauguucgagccggagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccccgguggcuggacgcccgcaucuacuccgacccgcuggcccucaaggaguucaaggaguucgccgcgggccgcaagagccugacccugaaccucaucaccgagaugggccgccugcccaccuucaugacgcagaaggcccggaacgcccuggacaaccucgccguccugcacaccgccgaggccgggggccgcgccuacaaccacgcccuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcgcagauccagccccacuggaucgccgccagcaucauccuggaguucuuccugaucguccuccugaucccggagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggaguccgagagcaacauccuggacaucgaccugcgccccgccuccgccuggacccucuacgccguggcgacgaccuucgucaccccgaugcugcggcacagcaucgagaacuccagcgugaacgugucccugaccgccaucgccaaccaggccacgguccucaugggccuggggaagggcuggccccugagcaagauggacaucggggugccccuccuggcgaucggcugcuacucccaggugaaccccaucacccugaccgccgcccuccugcugcucgucgcccacuacgccaucaucgggccgggccugcaggcgaaggccacccgcgaggcccagaagcgggccgccgcgggcaucaugaagaaccccacgguggacgggaucaccgugaucgaccuggagcccauccccuacgacccgaaguucgagaagcagcucggccaggucaugcugcugauccucugcgugacccaggugcugaugaugcgcaccacgugggcccugugcgaggcccucacccuggccaccgggcccaucagcacccugugggagggcaaccccgggcgguucuggaacacgaccaucgccgucuccauggcgaacaucuuccgcggcagcuaccucgccggcgccgggcugcuguucuccaucaugaagaacaccaccagcacgcgccggggcaccgggaacaucggcgagacccucggcgagaaguggaagucccgccugaacgcccugggcaagagcgaguuccagaucuacaagaaguccggcauccaggagguggaccggacccucgcgaaggaggggaucaagcgcggcgagacggaccaccacgccgugagccggggguccgccaagcugcgcugguucgucgagcggaacauggugacccccgagggcaagguggucgaccugggcugcgggcgcggcggguggagcuacuacugcggcgggcucaagaacgugcgggaggugaagggccugaccaagggcgggccgggccacgaggagcccauccccaugagcaccuacggguggaaccugguccgccuccaguccggcguggacguguucuucacgcccccggagaagugcgacacccugcugugcgacaucggggagagcucccccaaccccaccaucgaggccggccggacccuccgcguccugaaccugguggagaacuggcucaacaacaacacccaguucugcaucaaggugcugaaccccuacaugccgagcgucaucgagaagauggaggcccugcagcggcaguacggcggggcgcucgugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagcccgacguggaccugggguccggcacgcgcaacaucgggaucgagagcgagaucccgaaccucgacaucaucggcaagcggaucgagaagaucaagcaggagcacgagaucuccuggcacuacgaccaggaccaccccuacaagaccugggccuaccacggcagcuacgagaccaagcagaccggguccgccagcuccauggucaacggcguggugcgccugcugacgaagcccugggacgucgugcccauggugacccagauggcgaugaccgacaccacgccguucgggcagcagcgcgucuucaaggagaagguggacacccggacccaggagcccaaggagggcaccaagaagcucaugaagaucacggccgaguggcuguggaaggagcugggcaagaagaagacgccccggaugugcacccgggaggaguucaccaagaaggugcgcagcaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucagccgcgggaacucccucagcggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggcccaccccgcgcggcacggugauggacaucaucucccggcgcgaccagcggggcagcgggcaggucggcaccuacgggcugaacaccuucaccaacauggaggcccagcucauccgccagauggagggcgagggcaucuucaaguccauccagcaccugacggccaccgaggagaucgccguccagaacuggcuggcgcgcguggggcgggagcgccucagccggauggccaucuccggcgacgacugcguggucaagcccaucgacgaccgcuucgccagcgcccugaccgcccugaacgacauggggaaggugcggaaggacauccagcagugggagcccucccgcggcuggaacgacuggacccaggugcccuucugcagccaccacuuccacgagcucgucaugaaggacgggcgggugcugguggucccgugccgcaaccaggacgagcugaucggccgggcgcgcaucucccagggcgccggguggagccucaaggagacggccugccugggcaaguccuacgcccagauguggacccugauguacuuccaccggcgcgaccuccggcuggccgcgaacgccaucugcagcgccgugcccucccacugggugcccaccagccgcaccaccugguccauccacgccaagcacgaguggaugacgaccgaggacaugcuggcggucuggaaccggguguggauccaggagaaccccuggauggaggacaagaccccgguggagagcugggaggagguccccuaccucgggaagcgcgaggaccaguggugcggcagccugaucgggcugaccucccgggccacgugggccaagaacauccagaccgccaucaaccaggugcgcagccucaucggcaacgaggaguacaccgacuacaugcccuccaugaagcgguuccgccgcgaggaggaggaggccggcgugcugugguga

SEQ ID NO: 9210 - RNA, 9876 nt, Artificial Sequence
  derived and/or modified CDS sequence (opt1) from DENV-2__EU569700__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucacgccgcccgagaagugcgacacccugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucaccaagaaggugcgcuccaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggccgacgccccgcggcacggugauggacaucaucagccggcgcgaccagcggggcuccgggcaggucggcaccuacgggcugaacaccuucaccaacauggaggcccagcucauccgccagauggagggcgagggcaucuucaagagcauccagcaccugacggccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9211 - RNA, 9876 nt, Artificial Sequence
  derived and/or modified CDS sequence (opt1) from DENV-2__KF955369__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccaccguggcccccagcaugaccaugcgcugcaucggcaucagcaaccgggacuucgucgagggcgugagcgggggcagcuggguggacaucguccucgagcacgggagcugcgugacgaccauggcgaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcgggcuguucggcaagggcggcaucgugaccugcgccauguucacgugcaagaagaacauggagggcaagguggugcagcccgagaaccuggaguacacgaucgucaucacgccccacagcggggaggagcacgcggugggcaacgacaccgggaagcacggcaaggagaucaagaucaccccgcaguccagcaucaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgccaagaagcaggacgucgugguccucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacagccccgugaacaucgaggccgagccgcccuucggcgacuccuacaucaucaucgggguggagccgggccagcugaagcucaacugguucaagaaggggagcuccaucggccagauguucgagaccaccaugcgcggcgcgaagcggauggccauccugggggacaccgccugggacuucggcagccucgggggcgucuucacguccaucgggaaggcccuccaccagguguucggcgccaucuacggcgcggccuucagcgggguguccuggaccaugaagauccugaucggcgucaucaucaccuggaucgggaugaacagccgcuccaccagccuguccgugagccuggugcucgucggcguggugacgcuguaccugggggccgucgugcaggccgacuccggcugcguggucagcuggaagaacaaggagcucaagugcggcuccgggaucuucaucaccgacaacgugcacaccuggaccgagcaguacaaguuccagcccgagagccccagcaagcuggcguccgccauccagaaggcccacgaggagggcaucugcgggauccggagcgugacgcgccuggagaaccucauguggaagcagaucacccccgagcugaaccacauccuguccgagaacgaggucaagcucaccaucaugaccggcgacaucaaggggaucaugcaggccggcaagcggagccugcgcccgcagcccacggagcugaaguacuccuggaagaccuggggcaaggccaagaugcucagcaccgagucccacaaccagaccuuccugaucgacgggcccgagacggcggagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggccgugcacgcggacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgccgggcccuggcaccucggcaagcuggagauggacuucgacuucugcgaggggaccacgguggucgugaccgaggacugcggcaaccggggccccagccugcgcaccaccacggcgagcgggaagcucaucaccgaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacgcgcaucggcaccaagcacgccauccugcucguggcggucagcuucgugacccugaucaccgggaacauguccuuccgggaccugggccgcgugauggucauggugggggccacgaugaccgacgacaucggcaugggcgugaccuaccucgcccugcuggccgccuucaagguccgccccaccuucgcggccgggcuccugcugcggaagcucacgagcaaggagcugaugauggccaccaucggcaucgcccugcucucccagagcaccauccccgagaccauccuggagcugacggacgcccucgcgcuggggaugauggugcugaagaucgugcgcaacauggagaaguaccagcucgccgucaccaucauggccaucuccugcgugccgaacgccgugauccugcagaacgccuggaaggucagcugcaccauccuggcggccguguccgucagcccccuccugcugaccuccagccagcagaaggccgacuggaucccccucgcccugacgaucaagggccugaaccccaccgcgaucuuccucaccacccugucccggacgagcaagaagcgcuccuggccgcugaacgaggccaucauggccgugggcauggugagcauccucgccuccagccugcugaagaacgacauccccaugaccgggccccucgucgccggcgggcugcugaccgugugcuacgugcucaccggccggagcgcggaccuggagcuggagcgcgccgccgacgucaagugggaggaccaggccgagaucuccgggagcucccccauccucagcaucacgaucuccgaggacggcagcauguccaucaagaacgaggaggaggagcagacccugaccauccugauccggaccggccuccuggugaucagcgggguguucccggucuccauccccaucaccgccgcggccugguaccugugggaggugaagaagcagcgcgccggcgugcucugggacguccccagcccgccgcccguggagaaggccgagcuggaggacggggccuaccggaucaagcagcgcggcauccugggguacucccagaucggcgcgggcguguacaaggaggggacguuccacaccauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgccgugcagaccaagcccgggaucuucaagacgaacaccggcaccaucggggcggucagccuggacuucucccccggcaccagcggcucccccaucguggaccggaaggggaagguggucggccucuacgggaacggcguggugacgcgcagcggcgccuacgucuccgccaucgcccagaccgagaaguccaucgaggacaaccccgagaucgaggacgacaucuuccggaagaagcgccugaccaucauggaccugcaccccggggcgggcaagaccaagcgguaccuccccgccaucgugcgcgaggccaucaagcgggggcugcgcacgcugauccuggccccgacccgcguggucgccgcggagauggaggaggcccuccggggccugcccauccgcuaccagacccccgccaucaagaccgagcacacggggcgggagaucguggaccugaugugccacgccaccuucaccaugcgccuccugagccccgugcgggucccgaacuacaaccugaucaucauggacgaggcccacuucaccgaccccgcguccaucgccgcccgcggcuacaucagcacgcggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugaccgacuucaagggcaagacggucugguucgugccguccaucaaggccgggaacgacaucgccgcgugccuccggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccccggcgcugcaugaagcccgugauccugaccgacggggaggagcgggugauccucgccggccccaugccggucacccacuccagcgcggcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcgcgcaagacguucguggaccugaugcggcgcggcgaccuccccgucuggcuggccuacaagguggccgccgaggggaucaacuacgccgaccggaaguggugcuucgacggcaucaagaacaaccagauccuggaggagaacauggagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucaccgagaugggccgccugcccacguucaugacccagaaggcgcggaacgcccuggacaaccucgccguccugcacaccgccgaggccgggggccgcgcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcggacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcgcccggccagcgccuggacgcucuacgccguggccaccaccuucgucacccccaugcugcggcacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgcgaggcccagaagcgggccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcgcacgaccugggcgcugugcgaggcccucacccuggccaccgggcccaucuccacgcugugggagggcaaccccgggcgguucuggaacaccaccaucgccgucagcauggccaacaucuuccgcggcuccuaccucgcgggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgccaaggaggggaucaagcgcggcgagaccgaccaccacgcggugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcacguacggguggaaccugguccgccuccagagcggcguggacguguucuucaccccgcccgagaagugcgacacccugcugugcgacaucggggaguccagccccaaccccaccaucgaggccggccggacccuccgcguccugaaccugguggagaacuggcucaacaacaacacgcaguucugcaucaaggugcugaacccguacaugcccuccgucaucgagaagauggaggcccugcagcggcaguacggcggggcccucgugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcugaccaagcccugggacgucgugccgauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagacgccccgcaugugcacccgggaggaguucacgaagaaggugcgcuccaacgccgcccucggggccaucuucaccgacgagaacaaguggaaguccgcccgggaggcggucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcccgguuccucgaguucgaggcgcugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacgcggaucacccuggaggaccugaagaacgaggagauggucaccaaccacaugaagggggagcacaagaagcucgccgaggcgaucuucaagcugaccuaccagaacaagguggugcgcguccagcggccgacgccccgcggcaccgugauggacaucaucagccggcgcgaccagcggggcuccgggcaggucggcaccuacgggcugaacaccuucacgaacauggaggcccagcucauccgccagauggagggcgagggcaucuucaagagcauccagcaccugaccgccaccgaggagaucgccguccagaacuggcuggcccgcguggggcgggagcgccucucccggauggcgaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcccgcaucagccagggcgcgggguggucccucaaggagaccgccugccugggcaagagcuacgcccagauguggacccugauguacuuccaccggcgcgaccuccggcuggccgccaacgcgaucugcuccgccgugcccagccacugggugcccaccucccgcaccacguggagcauccacgccaagcacgaguggaugaccaccgaggacaugcuggccgucuggaaccggguguggauccaggagaacccguggauggaggacaagacccccguggaguccugggaggagguccccuaccucgggaagcgcgaggaccaguggugcggcagccugaucgggcugacgagccgggcgaccugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9212 - RNA, 9876 nt, Artificial Sequence
  derived and/or modified CDS sequence (opt1) from DENV-2__EU569702__SS-prME
accgccggcgucaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagcgcgccagcuucaucgaggugaaguccugccacuggcccaagagccacacccugugguccaacggcguccuggagagcgagaugaucauccccaagaacuucgccgggcccgugucccagcacaacuaccggccgggcuaccacacgcagaccgcggggcccuggcaccucggcaagcuggagauggacuucgacuucugcgaggggaccaccguggucgugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggugaacagccuggucaccgccgggcacggccagaucgacaacuucucccucggcgugcuggggauggcccuguuccucgaggagaugcugcgcacccggaucggcacgaagcacgcgauccugcucguggccgucagcuucgugacccugaucaccgggaacauguccuuccgcgaccugggccgcgugauggucauggugggggccaccaugacggacgacaucggcaugggcgugaccuaccucgcccugcuggccgcguucaagguccggcccaccuucgccgccgggcuccugcugcgcaagcucaccagcaaggagcugaugauggccacgaucggcaucgcccugcucucccagagcaccauccccgagaccauccuggagcugaccgacgcgcucgcccuggggaugauggugcugaagaucgugcggaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccgugggcauggugagcauccucgccuccagccugcugaagaacgacauccccaugacggggccccucgucgcgggcgggcugcugaccgugugcuacgugcucaccggccgcagcgccgaccuggagcuggagcgggccgccgacgucaagugggaggaccaggccgagaucuccgggagcucccccauccucagcaucaccaucuccgaggacggcagcauguccaucaagaacgaggaggaggagcagacgcugaccauccugauccgcaccggccuccuggugaucagcgggguguucccggucuccauccccaucaccgcggccgccugguaccugugggaggugaagaagcagcgggccggcgugcucugggacguccccagcccgccgcccguggagaaggccgagcuggaggacggggcguaccgcaucaagcagcggggcauccugggguacucccagaucggcgccggcguguacaaggaggggaccuuccacacgauguggcacgucacccgcggcgccgugcucaugcaccgggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggaucuucaagaccaacacgggcaccaucggggccgucagccuggacuucucccccggcaccagcggcucccccaucguggaccgcaaggggaagguggucggccucuacgggaacggcguggugacccggagcggcgccuacgucuccgccaucgcgcagacggagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcgcacccugauccuggccccgacgcggguggucgcggccgagauggaggaggcccuccgcggccugcccauccgguaccagacccccgccaucaagaccgagcacaccgggcgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccuccgcaagaacggcaagaaggugauccagcugagccggaagacguucgacuccgaguacgucaagacccgcgccaacgacugggacuucguggugaccaccgacaucagcgagaugggcgccaacuucaaggccgagcgggucaucgacccccgccggugcaugaagcccgugauccugacggacuccgaggagcgcgugauccucgcggggcccaugccggucacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgaggggaucaucccgagcauguucgagcccgagcgcgagaagguggacgcgaucgacggcgaguaccggcugcgcggcgaggcccggaagaccuucguggaccugaugcgccgcggggaccuccccgucuggcuggccuacaagguggccgccgagggcaucaacuacgcggaccgcaaguggugcuucgacgggaucaagaacaaccagauccuggaggagaacauggagguggagaucuggacgaaggagggcgagcggaagaagcucaagccgcgcuggcuggacgcccggaucuacuccgacccccuggcccucaaggaguucaaggaguucgccgcggggcgcaagagccugacccugaaccucaucaccgagaugggccggcugcccaccuucaugacgcagaaggcccgcaacgcccuggacaaccucgccguccugcacaccgccgaggcgggcgggcgggccuacaaccacgcccuguccgagcuccccgagacccuggagacccugcuccugcugacgcuccuggccaccgugaccggcgggaucuuccuguuccucaugagcggcaagggcaucgggaagaugacccugggcaugugcugcaucaucaccgccuccauccugcucugguacgcgcagauccagccgcacuggaucgccgccagcaucauccuggaguucuuccugaucguccuccugauccccgagcccgagaagcagcgcacgccccaggacaaccagcugaccuacguggugaucgccauccucaccgucguggccgcgaccauggccaacgagaugggguuccuggagaagacgaagaaggaccugggccucgggagcaucaccacccaggaguccgagagcaacauccuggacaucgaccugcggccggccuccgccuggacccucuacgccguggcgacgaccuucgucacccccaugcugcgccacagcaucgagaacuccagcgugaacgugucccugaccgccaucgccaaccaggccacgguccucaugggccugggcaagggguggccccugagcaagauggacaucggcgugccccuccuggcgaucgggugcuacucccaggugaacccgaucacccugaccgccgcccuccugcugcucgucgcccacuacgccaucaucggccccgggcugcaggcgaaggccacccgggaggcccagaagcgcgccgccgcgggcaucaugaagaaccccacgguggacggcaucaccgugaucgaccuggagcccaucccguacgaccccaaguucgagaagcagcucgggcaggucaugcugcugauccucugcgugacccaggugcugaugaugcggaccacgugggcccugugcgaggcccucacccuggccaccggccccaucagcacccugugggaggggaaccccggccgcuucuggaacacgaccaucgccgucuccauggcgaacaucuuccgcgggagcuaccucgccggcgccggccugcuguucuccaucaugaagaacaccaccagcacgcggcgcgggaccggcaacaucggggagacccucggcgagaaguggaagucccggcugaacgcccugggcaagagcgaguuccagaucuacaagaaguccgggauccaggagguggaccgcacccucgcgaaggagggcaucaagcgcggggagacggaccaccacgccgugagccgcggcuccgccaagcugcggugguucgucgagcgcaacauggugaccccggaggggaagguggucgaccugggcugcggccgcgggggcuggagcuacuacugcgggggccucaagaacgugcgcgaggugaaggggcugaccaagggcggccccgggcacgaggagcccauccccaugagcaccuacggcuggaaccugguccggcuccaguccgggguggacguguucuucacgccgcccgagaagugcgacacccugcugugcgacaucggcgagagcucccccaaccccaccaucgaggccgggcgcacccuccggguccugaaccugguggagaacuggcucaacaacaacacccaguucugcaucaaggugcugaacccguacaugcccagcgucaucgagaagauggaggcccugcagcgccaguacggcggcgcgcucgugcggaacccccugucccgcaacagcacgcacgagauguacuggguguccaacgccaccgggaacaucgucagcuccgugaacaugaucagccggaugcugaucaaccgcuucaccaugaagcacaagaaggccaccuacgagccggacguggaccugggcuccgggacgcggaacaucggcaucgagagcgagauccccaaccucgacaucaucgggaagcgcaucgagaagaucaagcaggagcacgagaucuccuggcacuacgaccaggaccaccccuacaagaccugggccuaccacggcagcuacgagaccaagcagaccggcuccgccagcuccauggucaacgggguggugcgccugcugacgaagcccugggacgucgugccgauggugacccagauggcgaugaccgacaccacgcccuucggccagcagcgggucuucaaggagaagguggacacccgcacccaggagcccaaggaggggaccaagaagcucaugaagaucacggccgaguggcuguggaaggagcugggcaagaagaagacgccccggaugugcacccgcgaggaguucaccaagaaggugcggagcaacgccgcccucggcgccaucuucacggacgagaacaaguggaaguccgcgcgcgaggccgucgaggacgggcgguucugggagcugguggaccgcgagcggaaccugcaccucgagggcaagugcgagaccugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucagccggggcaacucccucagcggggucgagggcgaggggcugcaccgccugggcuacauccuccgggacgugggcaagaaggagggcggcgccauguacgccgacgacaccgccgggugggacacccgcaucacgcuggaggaccugaagaacgaggagauggucaccaaccacaugaagggcgagcacaagaagcucgcggaggccaucuucaagcugaccuaccagaacaagguggugcggguccagcgcccgacgccccgggggacggugauggacaucaucucccgccgggaccagcgcggcagcggccagguggggaccuacggccugaacaccuucaccaacauggaggcccagcucauccgccagauggagggggagggcaucuucaaguccauccagcaccugacggccaccgaggagaucgccguccagaacuggcuggcgcgggugggccgcgagcggcucagccgcauggccaucuccggggacgacugcguggucaagcccaucgacgaccgguucgccagcgcccugaccgcccugaacgacaugggcaaggugcgcaaggacauccagcagugggagcccucccggggguggaacgacuggacccaggugccguucugcagccaccacuuccacgagcucgucaugaaggacggccgcgugcuggugguccccugccggaaccaggacgagcugaucgggcgcgcgcggaucucccagggcgccggcuggagccucaaggagacggccugccuggggaaguccuacgcccagauguggacccugauguacuuccaccgccgggaccuccgccuggccgcgaacgccaucugcagcgccgugcccucccacugggugcccaccagccggaccaccugguccauccacgccaagcacgaguggaugacgaccgaggacaugcuggcggucuggaaccgcguguggauccaggagaacccguggauggaggacaagacccccguggagagcugggaggagguccccuaccucggcaagcgggaggaccaguggugcgggagccugaucggccugaccucccgcgccacgugggccaagaacauccagaccgccaucaaccaggugcggagccucaucgggaacgaggaguacaccgacuacaugcccuccaugaagcgcuuccgccgggaggaggaggaggccggcgugcugugguga

SEQ ID NO: 9213 - RNA, 9876 nt, Artificial Sequence
  derived and/or modified CDS sequence (opt1) from DENV-2__EU482624__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccaacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacauccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgccgagacccagcacgggaccaucgugauccgcguccaguacgagggcgacggcucccccugcaagauccccuucgagaucacggaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacaccauguggcacgucacgcggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacaccggcacgaucggggccgucagccuggacuucucccccggcaccagcggcucccccaucguggaccggaaggggaagguggucggccucuacgggaacggcguggugacccgcagcggcgccuacgucuccgccaucgcgcagaccgagaaguccaucgaggacaaccccgagaucgaggacgacaucuuccggaagaagcgccugacgaucauggaccugcaccccggggccggcaagaccaagcgguaccuccccgccaucgugcgcgaggccaucaagcgggggcugcgcacccugauccuggccccgacccgcguggucgcggccgagauggaggaggcccuccggggccugcccauccgcuaccagacgcccgccaucaagaccgagcacaccgggcgggagaucguggaccugaugugccacgccaccuucacgaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggggaggagcgggugauccucgcgggccccaugccggucacgcacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacgcugaaccucaucaccgagaugggccgccugcccaccuucaugacccagaaggcccggaacgcccuggacaaccucgccguccugcacacggccgaggccgggggccgcgccuacaaccacgcccugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugacguacguggugaucgccauccucaccgucguggccgcgaccauggccaacgagaugggcuuccuggagaagaccaagaaggaccuggggcucggcagcaucacgacccaggagagcgaguccaacauccuggacaucgaccugcgcccggccagcgccuggacccucuacgccguggcgaccacguucgucacccccaugcugcggcacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacgcugaccgccgcccuccugcugcucgucgcccacuacgccaucaucgggcccggccugcaggcgaaggccacccgcgaggcccagaagcgggccgccgcgggcaucaugaagaaccccaccguggacgggaucacggugaucgaccuggagcccaucccguacgaccccaaguucgagaagcagcucggccaggucaugcugcugauccucugcgugacccaggugcugaugaugcgcaccaccugggcccugugcgaggcccucacgcuggccaccgggcccaucuccacccugugggagggcaaccccgggcgguucuggaacaccacgaucgccgucagcauggcgaacaucuuccgcggcuccuaccucgccggcgccgggcugcuguucagcaucaugaagaacaccaccuccacccgccggggcacggggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagaccgaccaccacgccgugucccgggggagcgccaagcugcgcugguucgucgagcggaacauggugacgccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucaccccgcccgagaagugcgacacgcugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacccacgagauguacugggugagcaacgccacgggcaacaucgucuccagcgugaacaugaucucccgcaugcugaucaaccgguucaccaugaagcacaagaaggccaccuacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccugcugaccaagcccugggacgucgugccgauggugacgcagauggcgaugaccgacaccacccccuucgggcagcagcgcgucuucaaggagaagguggacacgcggacccaggagcccaaggagggcaccaagaagcucaugaagaucaccgccgaguggcuguggaaggagcugggcaagaagaagacgccccgcaugugcacccgggaggaguucaccaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagacgugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacccuggaggaccugaagaacgaggagauggucacgaaccacaugaagggggagcacaagaagcucgcggaggccaucuucaagcugaccuaccagaacaagguggugcgcguccagcggccgacgccccgcggcaccgugauggacaucaucagccggcgcgaccagcggggcuccgggcaggucggcacguacgggcugaacaccuucaccaacauggaggcccagcucauccgccagauggagggcgagggcaucuucaagagcauccagcaccugaccgccacggaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacgcugauguacuuccaccggcgcgaccuccggcuggccgcgaacgccaucugcuccgccgugcccagccacugggugcccaccucccgcaccaccuggagcauccacgccaagcacgaguggaugaccacggaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccaccugggccaagaacauccagacggccaucaaccaggugcgcucccucaucggcaacgaggaguacaccgacuacaugcccagcaugaagcgguuccgccgcgaggaggaggaggccggcgugcugugguga

SEQ ID NO: 9214 - RNA, 9876 nt, Artificial Sequence
  derived and/or modified CDS sequence (opt1) from DENV-2__EU596500__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagauggugauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcaucggcacgaagcacgcgauccugcucgucgccgugagcuucgugacccugaucaccgggaacauguccuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucguccgcaacauggagaaguaccagcucgccgugacgaucauggccaucuccugcgugccgaacgccgucauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggucagcauccucgccuccagccugcugaagaacgacauccccaugacggggccccucguggcgggcgggcugcugaccgugugcuacguccucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcggggucuucccgguguccauccccaucaccgcggccgccugguaccugugggaggugaagaagcagcgcgccggcguccucugggacgugcccagcccgccgcccguggagaaggccgagcuggaggacggggcguaccggaucaagcagcgcggcauccugggguacucccagaucggcgccggcgucuacaaggaggggaccuuccacacgauguggcacgugacccggggcgccgugcucaugcaccgcgggaagcggaucgagcccagcugggccgacgucaagaaggaccugaucuccuacggcgggggcuggaagcuggagggcgaguggaaggagggggaggagguccaggugcucgcccuggagcccggcaagaacccccgcgcgguccagaccaagcccgggaucuucaagaccaacacgggcaccaucggggccgugagccuggacuucucccccggcaccagcggcucccccaucguggaccggaaggggaaggucgugggccucuacgggaacggcguggucacccgcagcggcgccuacguguccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcgucguggcggccgagauggaggaggcccuccggggccugcccauccgcuaccagacccccgccaucaagaccgagcacaccgggcgggagaucguggaccugaugugccacgccacguucaccaugcgccuccugagccccguccgggugccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgcggccugccuccggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccugacggacggggaggagcgggucauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucgucgaccugaugcggcgcggcgaccuccccguguggcuggccuacaagguggccgccgaggggaucaacuacgcggaccggaaguggugcuucgacggcaucaagaacaaccagauccuggaggagaacauggaggucgagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccgugcugcacaccgccgaggccgggggccgcgccuacaaccacgcccugagcgagcuccccgagacccuggagacccugcuccugcugacgcuccuggccaccgucaccgggggcaucuuccuguuccucauguccggcaagagcaucgggaagaugacccugggcaugugcugcaucaucaccgccuccauccugcucuggcacgcgcagauccagccgcacuggaucgccgccagcaucauccuggaguucuuccugaucgugcuccugauccccgagcccgagaagcagcggacgccccaggacaaccagcugaccuacguggucaucgccauccucaccgugguggccgcgaccauggccaacgagaugggguuccuggagaagacgaagaaggaccugggccucgggagcaucaccacccaggaguccgagagcaacauccuggacaucgaccugcgcccggccuccgccuggacccucuacgccgucgcgacgaccuucgugacccccaugcugcggcacagcaucgagaacuccagcgugaacgucucccugaccgccaucgccaaccaggccacggugcucaugggccugggcaagggguggccccugagcaagauggacaucggcgugccccucuucgcgaucgggugcuacuaccaggucaacccgaucacccugaccgccgcccugcuccugcugguggcccacaacgccaucaucggccaggggcuccaggcgaaggccacccgcgaggcccagaagcgggccgccgcgggcaucaugaagaaccccacgguggacggcaucaccgucaucgaccuggagcccauccccuacgacccgaaguucgagaagcagcugggccaggugaugcuccugauccugugcgugacccagguccucaugaugcgcaccacgugggcccugugcgaggcccugacccucgccaccggccccaucuccacccugugggaggggaaccccggccgguucuggaacacgaccaucgccgugagcauggcgaacaucuuccgcggguccuaccuggccggcgccggccuccuguucagcaucaugaagaacaccaccuccacgcgccgggggaccggcaacaucggggagacccugggcgagaaguggaagucccgccucaacgcccugggcaaguccgaguuccagaucuacaagaaguccgggauccaggagguggaccggacccuggcgaaggagggcaucaagcgcggggagacggaccaccacgccgucucccggggcagcgccaagcuccgcugguucguggagcggaacauggugacccccgaggggaaggucguggaccugggcugcggccgcgggggcugguccuacuacugcgggggccugaagaacgugcgggaggucaaggggcucaccaagggcggcccggggcacgaggagcccauccccaugagcaccuacggcuggaaccuggugcgccugcagagcgggguggacgucuucuucacgcccccggagaagugcgacacccuccugugcgacaucggcgaguccagccccaaccccaccaucgaggccgggcggacccugcgcgugcucaaccugguggagaacuggcugaacaacaacacccaguucugcaucaagguccucaaccccuacaugccguccgugaucgagaagauggaggcccugcagcggcaguacggcggcgcgcuggugcgcaacccccucagccggaacuccacgcacgagauguacugggucagcaacgccaccgggaacaucguguccagcgugaacaugaucucccgcaugcugaucaaccgguucaccaugaagcacaagaaggccaccuacgagcccgacgucgaccugggcagcgggacgcgcaacaucggcaucgagaacgagaucccgaaccuggacaucaucgggaagcggaucgagaagaucaagcaggagcacgagaucuccuggcacuacgaccaggaccaccccuacaagaccugggccuaccacggcagcuacgagaccaagcagaccggcuccgccagcuccauggugaacggggugguccgccuccugacgaagcccugggacguggugcccauggucacccagauggcgaugaccgacaccacgccguucggccagcagcgcguguucaaggagaagguggacacccggacccaggagcccaaggaggggaccaagaagcugaugaagaucacggccgaguggcucuggaaggagcugggcaagaagaagacgccccgcaugugcacccgggaggaguucacccgcaagguccggagcaacgccgcccugggcgccaucuucacggacgagaacaaguggaaguccgcgcgcgaggccguggaggacgggcgguucugggagcucguggaccgcgagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccggggcaacagccugagcgggguggagggcgaggggcuccaccgccugggcuacauccugcgggacgucggcaagaaggagggcggcgccauguacgccgacgacaccgccgggugggacacccgcaucacgcucgaggaccugaagaacgaggagauggugaccaaccacaugaagggcgagcacaagaagcuggcggaggccaucuucaagcucaccuaccagaacaaggugguccgggugcagcgccccaccccgcgggggacggugauggacaucaucucccgccgggaccagcgcggcagcggccaggucgggaccuacggccugaacaccuucaccaacauggaggcccagcugauccgccagauggagggggagggcaucuucaaguccauccagcaccucacggccaccgaggagaucgccgugcagaacuggcuggcgcgggugggccgcgagcggcugagccgcauggccaucuccggggacgacugcgucgugaagcccaucgacgaccgguucgccagcgcccucaccgcccugaacgacaugggcaaggugcgcaaggacauccagcagugggagcccucccggggguggaacgacuggacccagguccccuucugcagccaccacuuccacgagcuggugaugaaggacggccgcgugcucgucgugccgugccggaaccaggacgagcugaucgggcgcgcgcggaucucccagggcgccggcuggagccugaaggagacggccugccucgggaaguccuacgcccagauguggacccugauguacuuccaccgccgggaccugcgccucgccgcgaacgccaucugcagcgccgugcccucccacuggguccccaccagccggaccaccugguccauccacgccaagcacgaguggaugacgaccgaggacaugcuggcgguguggaaccgcguguggauccaggagaaccccuggauggaggacaagaccccggucgagagcugggaggaggugcccuaccugggcaagcgggaggaccaguggugcgggucccucaucggccugaccagccgcgccacgugggccaagaacauccagaccgccaucaaccaggugcggagccugaucgggaacgaggaguacaccgacuacaugcccuccaugaagcgcuuccgccgggaggaggaggaggccggcguccucugguga

SEQ ID NO: 9215 - RNA, 9876 nt, Artificial Sequence
  derived and/or modified CDS sequence (opt1) from DENV-2__EU482626__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacauccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgccgagacccagcacgggaccaucgugauccgcguccaguacgagggcgacggcucccccugcaagauccccuucgagaucacggaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccacccagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacaccauguggcacgucacgcggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacaccggcacgaucggggccgucagccuggacuucucccccggcaccagcggcucccccaucguggaccggaaggggaagguggucggccucuacgggaacggcguggugacccgcagcggcgccuacgucuccgccaucgcgcagaccgagaaguccaucgaggacaaccccgagaucgaggacgacaucuuccggaagaagcgccugacgaucauggaccugcaccccggggccggcaagaccaagcgguaccuccccgccaucgugcgcgaggccaucaagcgggggcugcgcacccugauccuggccccgacccgcguggucgcggccgagauggaggaggcccuccggggccugcccauccgcuaccagacgcccgccaucaagaccgagcacaccgggcgggagaucguggaccugaugugccacgccaccuucacgaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggggaggagcgggugauccucgcgggccccaugccggucacgcacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacgcugaaccucaucaccgagaugggccgccugcccaccuucaugacccagaaggcccggaacgcccuggacaaccucgccguccugcacacggccgaggccgggggccgcgccuacaaccacgcccugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugacguacguggugaucgccauccucaccgucguggccgcgaccauggccaacgagaugggcuuccuggagaagaccaagaaggaccuggggcucggcagcaucacgacccaggagagcgaguccaacauccuggacaucgaccugcgcccggccagcgccuggacccucuacgccguggcgaccacguucgucacccccaugcugcggcacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacgcugaccgccgcccuccugcugcucgucgcccacuacgccaucaucgggcccggccugcaggcgaaggccacccgcgaggcccagaagcgggccgccgcgggcaucaugaagaaccccaccguggacgggaucacggugaucgaccuggagcccaucccguacgaccccaaguucgagaagcagcucggccaggucaugcugcugauccucugcgugacccaggugcugaugaugcgcaccaccugggcccugugcgaggcccucacgcuggccaccgggcccaucuccacccugugggagggcaaccccgggcgguucuggaacaccacgaucgccgucagcauggcgaacaucuuccgcggcuccuaccucgccggcgccgggcugcuguucagcaucaugaagaacaccaccuccacccgccggggcacggggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagaccgaccaccacgccgugucccgggggagcgccaagcugcgcugguucgucgagcggaacauggugacgccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucaccccgcccgagaagugcgacacgcugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacccacgagauguacugggugagcaacgccacgggcaacaucgucuccagcgugaacaugaucucccgcaugcugaucaaccgguucaccaugaagcacaagaaggccaccuacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccugcugaccaagcccugggacgucgugccgauggugacgcagauggcgaugaccgacaccacccccuucgggcagcagcgcgucuucaaggagaagguggacacgcggacccaggagcccaaggagggcaccaagaagcucaugaagaucaccgccgaguggcuguggaaggagcugggcaagaagaagacgccccgcaugugcacccgggaggaguucaccaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagacgugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacccuggaggaccugaagaacgaggagauggucacgaaccacaugaagggggagcacaagaagcucgcggaggccaucuucaagcugaccuaccagaacaagguggugcgcguccagcggccgacgccccgcggcaccgugauggacaucaucagccggcgcgaccagcggggcuccgggcaggucggcacguacgggcugaacaccuucaccaacauggaggcccagcucauccgccagauggagggcgagggcaucuucaagagcauccagcaccugaccgccacggaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacgcugauguacuuccaccggcgcgaccuccggcuggccgcgaacgccaucugcuccgccgugcccagccacugggugcccaccucccgcaccaccuggagcauccacgccaagcacgaguggaugaccacggaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccaccugggccaagaacauccagacggccaucaaccaggugcgcucccucaucggcaacgaggaguacaccgacuacaugcccagcaugaagcgguuccgccgcgaggaggaggaggccggcgugcugugguga

SEQ ID NO: 9216 - RNA, 9876 nt, Artificial Sequence
  derived and/or modified CDS sequence (opt1) from DENV-2__EU482629__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccgucguggugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccggaucggcacgaagcacgcgauccuccuggucgccgugagcuucgugacccugaucaccgggaacauguccuucaaggaccucggccgcgucauggugaugaugggggccaccaugacggacgacaucggcaugggcgugaccuaccuggcccugcucgccgcguucaagguccgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucgugcgcaacauggagaaguaccagcuggccgucacgaucauggccaucuccugcgugccgaacgccgugauccugcagaacgcguggaaggucagcugcaccauccucgccgccguguccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccuggucgcgggcgggcugcucaccgugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacgcugaccauccucauccggaccggccugcuggugaucagcgggguguucccggucuccauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacucccagaucggcgccggcguguacaaggaggggaccuuccacacgauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagaccaagcccgggaucuucaagaccaacacgggcaccaucggggccgucagccucgacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgccccgacgcgcguggucgcggccgagauggaggaggcccugcggggccugcccauccgcuaccagaccaccgccaucaagaccgagcacacggggcgggagaucguggaccucaugugccacgccaccuucaccaugcgccugcugagccccgugcggguccccaacuacaaccucaucaucauggacgaggcgcacuucaccgacccggccuccaucgccgcccgcggcuacaucagcacgcggguggagaugggcgaggccgcggggaucuucaugaccgccacgccgcccggcucccgcgaccccuucccgcagagcaacgcccccaucauggacgaggagcgggagauccccgagcgcuccuggaacagcgggcacgagugggugaccgacuucaagggcaagacggucugguucgugcccuccaucaaggccgggaacgacaucgcggccugccugcggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccgcggcgcugcaugaagcccgugauccucaccgacggggaggagcgggugauccuggcgggccccaugcccgucacccacuccagcgccgcccagcgccgggggcgcaucggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgcgaucgacggcgaguaccgccugcgcggggaggcccgcaagacguucguggaccucaugcggcgcggcgaccugcccgucuggcuggccuacaagguggccgccgaggggaucaacuacgcggaccggaaguggugcuucgacggcaucaagaacaaccagauccucgaggagaacauggagguggagaucuggaccaaggagggggagcgcaagaagcugaagccccgguggcuggacgcccgcaucuacagcgacccgcucgcccugaaggaguucaaggaguucgccgcgggccggaagucccugacccucaaccugaucaccgagaugggccgccugcccacguucaugacccagaaggcccggaacgcccucgacaaccuggccguccugcacaccgccgaggccgggggccgcgccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcggacgccccaggacaaccagcucaccuacgucgugaucgccauccugaccgucguggccgcgacgauggccaacgagaugggcuuccuggagaagaccaagaaggaccucgggcugggcagcaucaccacccaggagagcgaguccaacauccuggacaucgaccuccgccccgccagcgccuggacgcuguacgccguggcgaccaccuucaucaccccgaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgcgaggcccagaagcgggccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggccgggccacgaggagcccauccccauguccacguacggguggaaccucgugcgccugcagagcggcgucgacguguucuucacgccgcccgagaagugcgacacccugcucugcgacaucggggagagcucccccaaccccaccaucgaggccggccggacccugcgcgugcugaaccucgucgagaacuggcugaacaacaacacgcaguucugcaucaaggugcugaaccccuacaugcccagcgugaucgagaagauggaggcccuccagcggaaguacggcggggcgcugguccgcaacccccugucccggaacagcacccacgagauguacuggguguccaacgccaccggcaacaucgugagcuccgucaacaugaucagccgcaugcugaucaaccgguucaccaugaagcacaagaaggccacguacgagcccgacguggaccucggguccggcacccgcaacaucgggaucgagagcgagaucccgaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcggagcaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacacggccggcugggacacccgcaucacccuggaggaccucaagaacgaggagauggugaccaaccacaugaagggggagcacaagaagcuggcggaggccaucuucaagcugacguaccagaacaaggugguccgggugcagcgccccaccccgcggggcaccgucauggacaucaucucccgccgggaccagcgcggcagcgggcaggucggcaccuacgggcucaacacguucaccaacauggaggcccagcugauccgccagauggagggcgagggcaucuucaaguccauccagcaccugaccgccaccgaggagaucgccgugcagaacuggcucgcgcgggucgggcgcgagcggcugagccgcauggccaucuccggcgacgacugcguggugaagcccaucgacgaccgguucgccagcgcccugacggcccucaacgacauggggaagauccgcaaggacauccagcagugggagcccucccggggcuggaacgacuggacccagguccccuucugcagccaccacuuccacgagcuggugaugaaggacgggcgcgugcuggucgugccgugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccgugcccucccacuggguccccaccagccggacgaccugguccauccacgccaagcacgaguggaugaccaccgaggacaugcucgcgguguggaaccgcguguggauccaggagaaccccuggauggaggacaagacgccggucgagagcugggaggaggugcccuaccuggggaagcgggaggaccaguggugcggcucccugaucgggcucaccagccgcgccaccugggccaagaacauccagaccgccaucaaccaggugcggagccugaucggcaacgaggaguacacggacuacaugcccuccaugaagcgcuuccgccgggaggaggaggaggccggcguccugugguga

SEQ ID NO: 9217 - RNA, 9876 nt, Artificial Sequence
  derived and/or modified CDS sequence (opt1) from DENV-2__FJ390390__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgaaguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggacaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccuccugcuggaggagaugcuccgcacccggaucggcacgaagcacgcgauccugcugguggccgugagcuucgucacccucaucaccgggaacauguccuuccgcgaccugggccgcgugauggugauggucggggccaccaugacggacgacaucggcaugggcgugaccuaccuggcccuccuggccgcguucaaggugcggcccaccuucgccgccgggcugcuccugcgcaagcugaccagcaaggagcucaugauggccacgaucggcaucgcccugcugucccagagcaccauccccgagaccauccucgagcugaccgacgcgcuggcccucgggaugaugguccugaagaucgugcggaacauggagaaguaccagcuggccgugacggucauggccaucuccugcgugccgaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccgcaccagcaagaagcgguccuggccgcugaacgaggccaucauggccgugggcauggugagcauccuggccuccagccuccugaagaacgacauccccaugacggggccccuggucgcgggcgggcuccugaccgugugcuacgugcugaccggccgcagcgccgaccucgagcuggagcgggccgccgacgucaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcgggguguucccggucuccauccccaucaccgcggccgccugguaccugugggaggugaagaagcagcgggccggcgugcugugggacguccccagcccgccgcccguggagaaggccgagcucgaggacggggcguaccgcaucaagcagcggggcauccugggguacucccagaucggcgccggcguguacaaggaggggaccuuccacacgauguggcacgucacccgcggcgccgugcugaugcaccgggggaagcgcaucgagcccagcugggccgacgugaagaaggaccucaucuccuacggcgggggcuggaagcuggagggcgaguggaaggagggggaggagguccaggugcuggcccucgagcccggcaagaacccccgggcggugcagaccaagcccgggaucuucaagaccaacacgggcaccaucggggccgucagccuggacuucucccccggcaccagcggcucccccaucguggaccgcaaggggaagguggucggccuguacgggaacggcguggugacccggagcggcgccuacgucuccgccaucgcgcagacggagaaguccaucgaggacaaccccgagaucgaggacgacaucuuccgcaagaagcggcucaccaucauggaccugcaccccggggccggcaagaccaagcgcuaccugcccgccaucgugcgggaggccaucaagcgcgggcugcgcacccucauccuggccccgacgcggguggucgcggccgagauggaggaggcccugcgcggccuccccauccgguaccagaccaccgccaucaagaccgagcacacggggcgcgagaucguggaccugaugugccacgccaccuucaccaugcggcugcucagccccgugcgcguccccaacuacaaccugaucaucauggacgaggcgcacuucaccgacccggccuccaucgccgcccggggcuacaucagcacgcgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggucugguucgugcccuccaucaaggccgggaacgacaucgcggccugccugcgcaagaacggcaagaaggugauccagcucagccggaagaccuucgacuccgaguacgucaagacccgcgccaacgacugggacuucguggugaccacggacaucagcgagaugggcgccaacuucaaggccgagcgggucaucgacccgcgccggugcaugaagcccgugauccugaccgacggggaggagcgcgugauccuggcgggccccaugcccgucacccacuccagcgccgcccagcggcgcgggcgcaucggccggaacccgaagaacgagaacgaccaguacaucuacaugggggagccccucgagaacgacgaggacugcgcccacuggaaggaggccaagaugcugcuggacaacaucaacacccccgagggcaucauccccuccauguucgagccggagcgcgagaagguggacgcgaucgacggcgaguaccggcuccgcggggaggcccggaagacguucguggaccugaugcgccggggcgaccugcccgucuggcucgccuacaagguggccgccgaggggaucaacuacgcggaccgcaaguggugcuucgacggcaucaagaacaaccagauccuggaggagaacauggagguggagaucuggaccaaggagggggagcggaagaagcugaagccccgcuggcucgacgcccggaucuacagcgacccgcuggcccugaaggaguucaaggaguucgccgcgggccgcaagucccucacccugaaccugaucaccgagaugggccggcuccccacguucaugacccagaaggcccgcaacgcccuggacaaccuggccguccuccacaccgccgaggccgggggccgggccuacaaccacgcccugagcgagcugcccgagacccucgagacgcugcugcuccugacccugcucgccaccgugaccgggggcaucuuccuguuccugauguccggcaaggggaucggcaagaugacccucgggaugugcugcaucaucacggccagcauccugcugugguacgcgcagauccagccccacuggaucgccgccuccaucauccucgaguucuuccugaucguccugcucaucccggagcccgagaagcagcgcacgccccaggacaaccagcugaccuacguggugaucgccauccugaccgucguggccgcgacgauggccaacgagaugggcuuccucgagaagaccaagaaggaccuggggcugggcagcaucaccacccaggagagcgaguccaacauccucgacaucgaccugcggcccgccagcgccuggacgcuguacgccguggcgaccaccuucgucaccccgaugcuccgccacuccaucgagaacagcuccgugaacgugagccugacggccaucgccaaccaggccaccguccugaugggccucgggaagggcuggccccuguccaagauggacaucggggugccccugcucgcgaucggcugcuacagccaggugaaccccaucacccugaccgccgcccugcuccugcuggucgcccacuacgccaucaucgggccgggccuccaggcgaaggccacgcgggaggcccagaagcgcgccgccgcgggcaucaugaagaaccccaccguggacgggaucaccgugaucgaccuggagcccauccccuacgacccgaaguucgagaagcagcugggccaggucaugcuccugauccugugcgugacccaggugcucaugaugcggacgaccugggcccugugcgaggcccugacccucgccaccgggcccaucuccacgcugugggagggcaaccccgggcgcuucuggaacaccaccaucgccgucagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcucaacgcccugggcaagagcgaguuccagaucuacaagaaguccggcauccaggagguggaccgcacgcuggcgaaggaggggaucaagcggggcgagaccgaccaccacgccgugagccgcggguccgccaagcuccggugguucgucgagcgcaacauggugacccccgagggcaagguggucgaccugggcugcgggcggggcggguggagcuacuacugcggcgggcugaagaacgugcgcgaggugaagggccucaccaagggcgggccgggccacgaggagcccauccccauguccacguacggguggaaccugguccggcugcagagcggcguggacguguucuucacgccgcccgagaagugcgacacccuccugugcgacaucggggagagcucccccaaccccaccaucgaggccggccgcacccugcggguccucaaccugguggagaacuggcugaacaacaacacgcaguucugcaucaaggugcucaaccccuacaugcccagcgucaucgagaagauggaggcccugcagcgcaaguacggcggggcgcuggugcggaacccccugucccgcaacagcacccacgagauguacuggguguccaacgccaccggcaacaucgucagcuccgugaacaugaucagccggaugcucaucaaccgcuucaccaugaagcacaagaaggccacguacgagcccgacguggaccugggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcgccuccugaccaagcccugggacgucgugcccauggugacccagauggcgaugacggacaccaccccguucgggcagcagcgggucuucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaaggugcgcagcaacgccgcccugggggccaucuucaccgacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcgucgagggggagggccuccaccggcugggcuacauccugcgcgacguggggaagaaggagggcggggccauguacgccgacgacacggccggcugggacacccggaucacccucgaggaccugaagaacgaggagauggucaccaaccacaugaagggggagcacaagaagcuggcggaggccaucuucaagcucacguaccagaacaagguggugcgcguccagcggcccaccccgcgcggcaccgugauggacaucaucucccggcgcgaccagcgcggcagcgggcaggucggcaccuacgggcugaacacguucaccaacauggaggcccagcugauccggcagauggagggcgagggcaucuucaaguccauccagcaccucaccgccaccgaggagaucgccguccagaacuggcuggcgcgcguggggcgggagcgccugagccggauggccaucuccggcgacgacugcguggucaagcccaucgacgaccgcuucgccagcgcccucacggcccugaacgacauggggaaggugcggaaggacauccagcagugggagcccucccgcggcuggaacgacuggacccaggugcccuucugcagccaccacuuccacgagcuggucaugaaggacgggcgggugcucguggucccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccgugcccucccacugggugcccaccagccgcacgaccugguccauccacgccaagcacgaguggaugaccaccgaggacaugcuggcggucuggaaccggguguggauccaggagaaccccuggauggaggacaagacgccgguggagagcugggaggagguccccuaccuggggaagcgcgaggaccaguggugcggcucccucaucgggcugaccagccgggccaccugggccaagaacauccagaccgccaucaaccaggugcgcagccugaucggcaacgaggaguacacggacuacaugcccuccaugaagcgcuuccggcgcgaggaggaggaggccggcgugcucugguga

SEQ ID NO: 9218 - RNA, 9876 nt, Artificial Sequence
  derived and/or modified CDS sequence (opt1) from DENV-2__FJ390391__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccaucuucgagcugaccgacgcgcuggcccucgggaugauggugcugaagaucgugcgcaacauggagaaguaccagcuggccgucacgaucauggccaucuccugcgugccgaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccggaccagcaagaagcgcuccuggccgcugaacgaggccaucauggccgugggcauggugagcauccuggccuccagccuccugaagaacgacauccccaugacggggccccuggucgcgggcgggcuccugaccgugugcuacgugcugaccggccggagcgccgaccucgagcuggagcgcgccgccgacgucaagugggaggaccaggccgagaucuccgggagcucccccauccugagcaucaccaucuccgaggacggcagcauguccaucaagaacgaggaggaggagcagacgcucaccauccugauccggaccggccugcucgugaucagcgggguguucccggucuccauccccaucaccgcggccgccugguaccugugggaggugaagaagcagcgcgccggcgugcugugggacguccccagcccgccgcccguggagaaggccgagcucgaggacggggcguaccggaucaagcagcgcggcauccugggguacucccagaucggcgccggcguguacaaggaggggaccuuccacacgauguggcacgucacccggggcgccgugcugaugcaccgcgggaagcggaucgagcccagcugggccgacgugaagaaggaccucaucuccuacggcgggggcuggaagcuggagggcgaguggaaggagggggaggagguccaggugcuggcccucgagcccggcaagaacccccgcgcggugcagaccaagcccgggaucuucaagaccaacacgggcaccaucggggccgucagccuggacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcuccgcacccugauccuggccccgacgcgcguggucgcggccgagauggaggaggcccugcggggccuccccauccgcuaccagacccccgccaucaagaccgagcacaccgggcgggagaucguggaccugaugugccacgccacguucaccaugcgccugcucagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcucagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccuggcgggccccaugccggucacccacuccagcgccgcccagcgccgggggcgcaucggccgcaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgggagaagguggacgcgaucgacggcgaguaccgccuccgcggggaggcccgcaagaccuucguggaccugaugcggcgcggcgaccugcccgucuggcucgccuacaagguggccgccgaggggaucaacuacgcggaccggaaguggugcuucgacggcaucaagaacaaccagauccuggaggagaacauggagguggagaucuggacgaaggagggggagcgcaagaagcugaagccgcgguggcucgacgcccgcaucuacagcgacccccuggcccugaaggaguucaaggaguucgccgcgggccggaagucccucacccugaaccugaucaccgagaugggccgccuccccaccuucaugacgcagaaggcccggaacgcccuggacaaccuggccguccuccacaccgccgaggccgggggccgcgccuacaaccacgcccugagcgagcugcccgagacccucgagacccugcugcuccugacgcugcucgccaccgugaccgggggcaucuuccuguuccugauguccggcaaggggaucggcaagaugacccucgggaugugcugcaucaucaccgccagcauccugcugugguacgcgcagauccagccgcacuggaucgccgccuccaucauccucgaguucuuccugaucguccugcucauccccgagcccgagaagcagcggacgccccaggacaaccagcugaccuacguggugaucgccauccugaccgucguggccgcgaccauggccaacgagaugggcuuccucgagaagacgaagaaggaccuggggcugggcagcaucaccacccaggagagcgaguccaacauccucgacaucgaccugcgcccggccagcgccuggacccuguacgccguggcgacgaccuucgucacccccaugcuccggcacuccaucgagaacagcuccgugaacgugagccugaccgccaucgccaaccaggccacgguccugaugggccucgggaagggcuggccccuguccaagauggacaucggggugccccugcucgcgaucggcugcuacagccaggugaacccgaucacccugaccgccgcccugcuccugcuggucgcccacuacgccaucaucgggcccggccuccaggcgaaggccacccgcgaggcccagaagcgggccgccgcgggcaucaugaagaaccccacgguggacgggaucaccgugaucgaccuggagcccaucccguacgaccccaaguucgagaagcagcugggccaggucaugcuccugauccugugcgugacccaggugcucaugaugcgcaccacgugggcccugugcgaggcccugacccucgccaccgggcccaucuccacccugugggagggcaaccccgggcgguucuggaacacgaccaucgccgucagcauggcgaacaucuuccgcggcuccuaccuggccggcgccgggcuccuguucagcaucaugaagaacaccaccuccacgcgccggggcaccgggaacaucggcgagacccugggcgagaaguggaagucccgccucaacgcccuggggaaguccgaguuccagaucuacaagaaguccggcauccaggagguggaccggacccuggcgaaggaggggaucaagcgcggcgagacggaccaccacgccgugucccgggggagcgccaagcuccgcugguucgucgagcggaacauggugaccccggagggcaagguggucgaccugggcugcgggcgcggcgggugguccuacuacugcggcgggcugaagaacgugcgggaggugaagggccucaccaagggcgggcccggccacgaggagcccauccccaugagcaccuacggguggaaccugguccgccugcagagcggcguggacguguucuucacgccgcccgagaagugcgacacccuccugugcgacaucggggaguccagccccaaccccaccaucgaggccggccggacccugcgcguccucaaccugguggagaacuggcugaacaacaacacccaguucugcaucaaggugcucaacccguacaugcccuccgucaucgagaagauggaggcccugcagcggcaguacggcggggcgcuggugcgcaacccccucagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgagaacgagauccccaaccuggacaucaucggcaagcggaucgagaagaucaagcaggagcacgagaucuccuggcacuacgaccaggaccaccccuacaagaccugggccuaccacggcagcuacgagaccaagcagaccggguccgccagcuccauggucaacggcguggugcgccuccugacgaagcccugggacgucgugccgauggugacccagauggcgaugaccgacaccacgcccuucgggcagcagcgcgucuucaaggagaagguggacacccggacccaggagcccaaggagggcaccaagaagcugaugaagaucacggccgaguggcucuggaaggagcugggcaagaagaagacgccccgcaugugcacccgggaggaguucaccaagaaggugcgcagcaacgccgcccugggggccaucuucacggacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcgucgagggggagggccuccaccggcugggcuacauccugcgcgacguggggaagaaggagggcggggccauguacgccgacgacaccgccggcugggacacccggaucacgcucgaggaccugaagaacgaggagauggucaccaaccacaugaagggggagcacaagaagcuggcggaggccaucuucaagcucaccuaccagaacaagguggugcgcguccagcggccgacgccccgcggcacggugauggacaucaucucccggcgcgaccagcggggcagcgggcaggucggcaccuacgggcugaacaccuucaccaacauggaggcccagcugauccgccagauggagggcgagggcaucuucaaguccauccagcaccucacggccaccgaggagaucgccguccagaacuggcuggcgcgcguggggcgggagcgccugagccggauggccaucuccggcgacgacugcguggucaagcccaucgacgaccgcuucgccagcgcccucaccgcccugaacgacauggggaaggugcggaaggacauccagcagugggagcccucccgcggcuggaacgacuggacccaggugccguucugcagccaccacuuccacgagcuggucaugaaggacgggcgggugcucgugguccccugccgcaaccaggacgagcugaucggccgggcgcgcaucucccagggcgccggguggagccugaaggagacggccugccucggcaaguccuacgcccagauguggacccugauguacuuccaccggcgcgaccugcggcucgccgcgaacgccaucugcagcgccgugcccucccacugggugcccaccagccgcaccaccugguccauccacgccaagcacgaguggaugacgaccgaggacaugcuggcggucuggaaccggguguggauccaggagaacccguggauggaggacaagacccccguggagagcugggaggagguccccuaccuggggaagcgcgaggaccaguggugcggcucccucaucgggcugaccagccgggccacgugggccaagaacauccagaccgccaucaaccaggugcgcagccugaucggcaacgaggaguacaccgacuacaugcccuccaugaagcgguuccgccgcgaggaggaggaggccggcgugcucugguga

SEQ ID NO: 9219 - RNA, 9876 nt, Artificial Sequence
  derived and/or modified CDS sequence (opt1) from DENV-2__FJ882593__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccaggagagcaacuggauccagaaggagacgcuggugaccuucaagaacccccacgcgaagaagcaggacgucgugguccucggcucccaggagggggccaugcacaccgcccugaccggcgccacggagauccagaugagcagcgggaaccuccucuucaccggccaccugaagugccgccugcggauggacaagcuccagcugaagggcauguccuacagcaugugcaccgggaaguucaagaucgugaaggagaucgccgagacccagcacggcacgaucgugauccgcguccaguacgagggggacggcucccccugcaagauccccuucgagaucaccgaccuggagaagcggcacgugcucggccgccugaucaccgugaacccgaucgucaccgagaaggacagccccgugaacaucgaggcggagccgcccuucggggacuccuacaucaucaucggcguggagccggggcagcugaagcucaacugguucaagaagggcagcuccaucgggcagauguucgagacgaccaugcgcggcgccaagcggauggccauccugggcgacaccgccugggacuucgggagccugggcggggucuucaccuccaucggcaaggcccuccaccagguguucggggcgaucuacggcgccgccuucagcggcguguccuggacgaugaagauccugaucggggucaucaucaccuggaucggcaugaacagccgcuccaccagccuguccgugagccuggugcucgucgggguggugacccuguaccugggcgccgucgugcaggcggacuccgggugcguggucagcuggaagaacaaggagcucaagugcggcuccggcaucuucaucacggacaacgugcacaccuggaccgagcaguacaaguuccagcccgagagccccagcaagcuggccuccgccauccagaaggcccacgaggaggggaucugcggcauccggagcgugacccgccuggagaaccucauguggaagcagaucacgcccgagcugaaccacauccuguccgagaacgaggucaagcucaccaucaugaccggggacaucaagggcaucaugcaggccgggaagcggagccugcgcccgcagcccaccgagcugaaguacuccuggaagacguggggcaaggcgaagaugcucagcaccgagucccacaaccagaccuuccugaucgacggccccgagaccgccgagugcccgaacacgaaccgggccuggaacagccuggagguggaggacuacggguucggcguguucaccaccaacaucuggcucaagcugcgcgagaagcaggacgucuucugcgacuccaagcugaugagcgccgccaucaaggacaaccgggcggugcacgccgacaugggguacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccggccccgugucccagcacaacuaccgcccgggguaccacacgcagaccgcgggccccuggcaccucgggaagcuggagauggacuucgacuucugcgagggcaccaccguggucgugacggaggacugcgggaaccggggccccagccugcgcaccaccaccgccagcggcaagcucaucacggaguggugcugccgguccugcacccugcccccgcugcgcuaccgcggggaggacggcugcugguacgggauggagauccgcccccucaaggagaaggaggagaaccuggugaacagccuggucaccgccggccacgggcagaucgacaacuucucccucggcgugcugggcauggcccuguuccucgaggagaugcugcggacccgcaucgggacgaagcacgcgauccugcucguggccgucagcuucgugacccugaucaccggcaacauguccuuccgggaccuggggcgcgugauggucauggugggcgccaccaugacggacgacaucgggaugggcgugaccuaccucgcccugcuggccgcguucaagguccgccccaccuucgccgccggccuccugcugcggaagcucaccagcaaggagcugaugauggccacgaucgggaucgcccugcucucccagagcaccauccccgagaccauccuggagcugaccgacgcgcucgcccugggcaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaaggggcugaaccccacggccaucuuccucaccacccugucccggaccagcaagaagcgcuccuggccgcugaacgaggccaucauggccgugggcauggugagcauccucgccuccagccugcugaagaacgacauccccaugacgggcccccucgucgccggcgggcugcugaccgugugcuacgugcucaccgggcggagcgccgaccuggagcuggagcgcgccgccgacgucaagugggaggaccaggccgagaucuccgggagcucccccauccucagcaucaccaucuccgaggacgggagcauguccaucaagaacgaggaggaggagcagacgcugaccauccugauccggaccggccuccuggugaucagcggcguguucccggucuccauccccaucaccgcggccgccugguaccugugggaggugaagaagcagcgcgccggggugcucugggacguccccagcccgccgcccguggagaaggccgagcuggaggacggcgcguaccggaucaagcagcgcgggauccugggcuacucccagaucggggccggcguguacaaggagggcaccuuccacacgauguggcacgucacccgcggggcggugcucaugcaccggggcaagcggaucgagcccagcugggccgacgugaagaaggaccugaucuccuacgggggcggguggaagcuggagggcgaguggaaggagggcgaggagguccaggugcucgcccuggagcccgggaagaacccccgcgcggugcagaccaagcccggcaucuucaagaccaacacggggaccaucggcgccgucagccuggacuucucccccgggaccagcggcucccccaucguggaccggaagggcaagguggucgggcucuacggcaacgggguggugacccgcagcggcgccuacgucuccgccaucgcgcagacggagaaguccaucgaggacaaccccgagaucgaggacgacaucuuccggaagaagcgccugaccaucauggaccugcaccccggcgccgggaagaccaagcgguaccuccccgccaucgugcgcgaggccaucaagcggggccugcgcacccugauccuggccccgacgcgcguggucgcggccgagauggaggaggcccuccgggggcugcccauccgcuaccagacccccgccaucaagaccgagcacaccggccgggagaucguggaccugaugugccacgccacguucaccaugcgccuccugagccccgugcgggucccgaacuacaaccugaucaucauggacgaggcgcacuucaccgaccccgccuccaucgccgcccgcggguacaucagcacccggguggagaugggcgaggccgcgggcaucuucaugacggccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccuccggaagaacgggaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggcgaggagcgggugauccucgcggggcccaugccggucacccacuccagcgccgcccagcgccggggccgcaucgggcgcaaccccaagaacgagaacgaccaguacaucuacaugggcgagccccuggagaacgacgaggacugcgcccacuggaaggaggccaagaugcugcucgacaacaucaacacccccgaggggaucaucccguccauguucgagcccgagcgggagaagguggacgcgaucgacggcgaguaccgccugcggggcgaggcccgcaagaccuucguggaccugaugcggcgcggggaccuccccgucuggcuggccuacaagguggccgccgagggcaucaacuacgcggaccggaaguggugcuucgacgggaucaagaacaaccagauccuggaggagaacauggagguggagaucuggacgaaggagggcgagcgcaagaagcucaagccgcgguggcuggacgcccgcaucuacagcgacccccuggcccucaaggaguucaaggaguucgccgcggggcggaagucccugacccugaaccucaucaccgagaugggccgccugcccaccuucaugacgcagaaggcccggaacgcccuggacaaccucgccguccugcacaccgccgaggcgggcgggcgcgccuacaaccacgcccugagcgagcuccccgagacccuggagacccugcuccugcugacgcuccuggccaccgugaccggcgggaucuuccuguuccucauguccggcaagggcaucgggaagaugacccugggcaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggguuccuggagaagacgaagaaggaccugggccucgggagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccugggcaagggguggccccuguccaagauggacaucggcgugccccuccuggcgaucgggugcuacagccaggugaacccgaucacccugaccgccgcccuccugcugcucgucgcccacuacgccaucaucggccccgggcugcaggcgaaggccacccgcgaggcccagaagcgggccgccgcgggcaucaugaagaaccccacgguggacggcaucaccgugaucgaccuggagcccaucccguacgaccccaaguucgagaagcagcucgggcaggucaugcugcugauccucugcgugacccaggugcugaugaugcgcaccacgugggcccugugcgaggcccucacccuggccaccggccccaucuccacccugugggaggggaaccccggccgguucuggaacacgaccaucgccgucagcauggcgaacaucuuccgcggguccuaccucgccggcgccggccugcuguucagcaucaugaagaacaccaccuccacgcgccgggggaccggcaacaucggggagacccucggcgagaaguggaagucccgccugaacgcccugggcaaguccgaguuccagaucuacaagaaguccgggauccaggagguggaccggacccucgcgaaggagggcaucaagcgcggggagacggaccaccacgccgugucccggggcagcgccaagcugcgcugguucgucgagcggaacauggugaccccggaggggaagguggucgaccugggcugcggccgcgggggcugguccuacuacugcgggggccucaagaacgugcgggaggugaaggggcugaccaagggcggccccgggcacgaggagcccauccccaugagcaccuacggcuggaaccugguccgccuccagagcgggguggacguguucuucacgccgcccgagaagugcgacacccugcugugcgacaucggcgaguccagccccaaccccaccaucgaggccgggcggacccuccgcguccugaaccugguggagaacuggcucaacaacaacacccaguucugcaucaaggugcugaacccguacaugcccuccgucaucgagaagauggaggcccugcagcggcaguacggcggcgcgcucgugcgcaacccccugagccggaacuccacgcacgagauguacugggugagcaacgccaccgggaacaucgucuccagcgugaacaugaucucccgcaugcugaucaaccgguucaccaugaagcacaagaaggccaccuacgagccggacguggaccugggcagcgggacgcgcaacaucggcaucgaguccgagauccccaaccucgacaucaucgggaagcggaucgagaagaucaagcaggagcacgagaucagcuggcacuacgaccaggaccaccccuacaagaccugggccuaccacggcuccuacgagaccaagcagaccggcagcgccuccagcauggucaacgggguggugcgccugcugacgaagcccugggacgucgugccgauggugacccagauggcgaugaccgacaccacgcccuucggccagcagcgcgucuucaaggagaagguggacacccggacccaggagcccaaggaggggaccaagaagcucaugaagaucacggccgaguggcuguggaaggagcugggcaagaagaagacgccccgcaugugcacccgggaggaguucaccaagaaggugcgcuccaacgccgcccucggcgccaucuucacggacgagaacaaguggaaguccgcgcgggaggccgucgaggacgggcgcuucugggagcugguggaccgggagcgcaaccugcaccucgagggcaagugcgagaccugcguguacaacaugauggggaagcgggagaagaagcugggcgaguucgggaaggccaagggcucccgcgccaucugguacauguggcugggcgcgcgguuccucgaguucgaggcccugggguuccugaacgaggaccacugguucagccgcggcaacagccucuccggggucgagggcgaggggcugcaccggcugggcuacauccuccgcgacgugggcaagaaggagggcggggccauguacgccgacgacaccgccgggugggacacccggaucacgcuggaggaccugaagaacgaggagauggucaccaaccacaugaagggcgagcacaagaagcucgcggaggccaucuucaagcugaccuaccagaacaagguggugcgcguccagcggccgacgccccgcgggacggugauggacaucaucagccggcgcgaccagcggggcuccggccagguggggaccuacggccugaacaccuucaccaacauggaggcccagcucauccgccagauggagggggagggcaucuucaagagcauccagcaccugacggccaccgaggagaucgccguccagaacuggcuggcgcgcgugggccgggagcgccucucccggauggccaucagcggggacgacugcguggucaagcccaucgacgaccgcuucgccuccgcccugaccgcccugaacgacaugggcaaggugcggaaggacauccagcagugggagcccagccgcggguggaacgacuggacccaggugccguucugcucccaccacuuccacgagcucgucaugaaggacggccgggugcuggugguccccugccgcaaccaggacgagcugaucgggcgggcgcgcaucagccagggcgccggcuggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucggcaagcgcgaggaccaguggugcgggagccugaucggccugaccagccgggccacgugggccaagaacauccagaccgccaucaaccaggugcgcucccucaucgggaacgaggaguacaccgacuacaugcccagcaugaagcgguuccgccgcgaggaggaggaggccggcgugcugugguga

SEQ ID NO: 9220 - RNA, 9876 nt, Artificial Sequence
  derived and/or modified CDS sequence (opt1) from DENV-2__FJ182014__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugccccuuccuccgccagaacgagcccgaggacaucgacugcuggugcaacagcaccagcaccugggucacguacgggaccugcaccaccacgggcgagcaccggcgcgagaagcgguccguggcccuggugccccacgucgggaugggccuggagacccgcaccgagaccuggaugagcagcgagggggccuggaagcacgugcagcggaucgagacguggauccuccgccacccgggcuucaccaucauggccgcgauccuggccuacaccaucgggaccacgcacuuccagcgggcccugaucuucauccuccugaccgccguggcgcccagcaugaccaugcgcugcaucggcaucagcaaccgggacuucgucgagggcgugagcgggggcagcuggguggacaucguccuggagcacgggagcugcgugaccacgauggccaagaacaagcccacccucgacuucgagcugaucaagaccgaggccaagcagcccgccacccugcgcaaguacugcaucgaggccaagcucacgaacaccaccaccgagagccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccucgaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccuggacuucaacgagaugguccuccugcagauggaggacaaggccuggcuggugcaccggcagugguuccucgaccugccccugcccuggcucccgggggccgacacccagggcagcaacuggauccagaaggagacgcuggugaccuucaagaacccccacgcgaagaagcaggacgucgugguccuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcuggggcgccucaucaccgugaacccgaucgucaccgagaaggacagccccgugaacaucgaggcggagccgcccuucggcgacuccuacaucaucaucgggguggagccgggccagcugaagcugaacugguucaagaaggggagcuccaucggccagauguucgagacgaccaugcgcggcgccaagcggauggccauccucggggacaccgccugggacuucggcagccucgggggcgucuucaccuccaucgggaaggcccugcaccagguguucggcgcgaucuacggcgccgccuucagcgggguguccuggacgaugaagauccucaucggcgucaucaucaccuggaucgggaugaacagccgcuccaccagccuguccgugagccuggugcuggucggcguggugacccucuaccugggggccgucgugcaggcggacuccggcugcguggucagcuggaagaacaaggagcugaagugcggcuccgggaucuucaucacggacaacgugcacaccuggaccgagcaguacaaguuccagcccgagagccccagcaagcucgccuccgccauccagaaggcccacgaggagggcaucugcgggauccggagcgugacccgccuggagaaccugauguggaagcagaucacgcccgagcucaaccacauccuguccgagaacgaggucaagcugaccaucaugaccggcgacaucaaggggaucaugcaggccggcaagcggagccuccgcccgcagcccaccgagcugaaguacuccuggaagacguggggcaaggcgaagaugcugagcaccgagucccacaaccagaccuuccucaucgacgggcccgagaccgccgagugcccgaacacgaaccgggccuggaacagccuggagguggaggacuacggcuucgggguguucaccaccaacaucuggcugaagcuccgcgagaagcaggacgucuucugcgacuccaagcugaugagcgccgccaucaaggacaaccgggcggugcacgccgacaugggcuacuggaucgaguccgcccugaacgacaccuggaagauggagaaggccagcuucaucgaggugaaguccugccacuggcccaagagccacacccucugguccaacggcguccuggagagcgagaugaucauccccaagaacuucgccgggcccgugucccagcacaacuaccgcccgggcuaccacacgcagaccgcggggcccuggcaccugggcaagcucgagauggacuucgacuucugcgaggggaccaccguggucgugacggaggacugcggcaaccggggccccagccugcgcaccaccaccgccagcgggaagcugaucacggaguggugcugccgguccugcacccugccgccccugcgcuaccggggcgaggacgggugcugguacggcauggagauccgcccccugaaggagaaggaggagaaccucgugaacagccuggucaccgccgggcacggccagaucgacaacuucucccugggcgugcucgggauggcccuguuccuggaggagaugcuccggacccgcaucggcacgaagcacgcgauccugcugguggccgucagcuucgugacccucaucaccgggaacauguccuuccgggaccugggccgcgugauggucauggugggggccaccaugacggacgacaucggcaugggcgugaccuaccuggcccuccuggccgcguucaagguccgccccaccuucgccgccgggcugcuccugcggaagcugaccagcaaggagcucaugauggccacgaucggcaucgcccugcugucccagagcaccauccccgagaccauccucgagcugaccgacgcgcuggcccucgggaugauggugcugaagaucgugcgcaacauggagaaguaccagcuggccgucacgaucauggccaucuccugcgugcccaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccggaccagcaagaagcgcuccuggccgcugaacgaggccaucauggccgugggcauggugagcauccuggccuccagccuccugaagaacgacauccccaugacggggccccuggucgcgggcgggcuccugaccgugugcuacgugcugaccggccggagcgccgaccucgagcuggagcgcgccgccgacgucaagugggaggaccaggccgagaucuccgggagcucccccauccugagcaucaucaucuccgaggacggcagcauguccaucaagaacgaggaggaggagcagacccucacgauccugauccggaccggccugcucgugaucagcgggguguucccggucuccauccccaucaccgcggccgccugguaccugugggaggugaagaagcagcgcgccggcgugcugugggacguccccuccccgccgcccguggagaaggccgagcucgaggacggggcguaccggaucaagcagcgcggcauccugggguacucccagaucggcgccggcguguacaaggaggggaccuuccacaccauguggcacgucacgcggggcgccgugcugaugcaccgcgggaagcggaucgagcccagcugggccgacgugaagaaggaccucaucuccuacggcgggggcuggaagcuggagggcgaguggaaggagggggaggagguccaggugcuggcccucgagcccggcaagaacccccgcgcggugcagaccaagcccgggaucuucaagaccaacaccggcacgaucggggccgucagccuggacuucucccccggcaccagcggcucccccaucguggaccggaaggggaagguggucggccuguacgggaacggcguggugacccgcagcggcgccuacgucuccgccaucgcgcagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcuccgcacccugauccuggccccgacccgcguggucgcggccgagauggaggaggcccugcggggccuccccauccgcuaccagacgcccgccaucaagaccgagcacaccgggcgggagaucguggaccugaugugccacgccaccuucacgaugcgccugcucagccccgugcgggucccgaacuacaaccugaucaucauggacgaggcgcacuucaccgaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcucagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggggaggagcgggugauccuggcgggccccaugccggucacgcacuccagcgccgcccagcgccgggggcgcaucggccgcaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgggagaagguggacgcgaucgacggcgaguaccgccuccgcggggaggcccgcaagaccuucguggaccugaugcggcgcggcgaccugcccgucuggcucgccuacaagguggccgccgaggggaucaacuacgcggaccggaaguggugcuucgacggcaucaagaacaaccagauccuggaggagaacauggagguggagaucuggaccaaggagggggagcgcaagaagcugaagccgcgguggcucgacgcccgcaucuacagcgacccccuggcccugaaggaguucaaggaguucgccgcgggccggaagucccucacgcugaaccugaucaccgagaugggccgccuccccaccuucaugacccagaaggcccggaacgcccuggacaaccuggccguccuccacacggccgaggccgggggccgcgccuacaaccacgcccugagcgagcugcccgagacccucgagacccugcugcuccugacccugcucgccacggugaccgggggcaucuuccuguuccugauguccggcaaggggaucggcaagaugacccucgggaugugcugcaucaucaccgccagcauccugcugugguacgcgcagauccagccgcacuggaucgccgccuccaucauccucgaguucuuccugaucguccugcucauccccgagcccgagaagcagcggacgccccaggacaaccagcugacguacguggugaucgccauccugaccgucguggccgcgaccauggccaacgagaugggcuuccucgagaagaccaagaaggaccuggggcugggcagcaucacgacccaggagagcgaguccaacauccucgacaucgaccugcgcccggccagcgccuggacccuguacgccguggcgaccacguucgucacccccaugcuccggcacuccaucgagaacagcuccgugaacgugagccugaccgccaucgccaaccaggccaccguccugaugggccucgggaagggcuggccccuguccaagauggacaucggggugccccugcucgcgaucggcugcuacagccaggugaacccgaucacgcugaccgccgcccugcuccugcuggucgcccacuacgccaucaucgggcccggccuccaggcgaaggccacccgcgaggcccagaagcgggccgccgcgggcaucaugaagaaccccaccguggacgggaucacggugaucgaccuggagcccaucccguacgaccccaaguucgagaagcagcugggccaggucaugcuccugauccugugcgugacccaggugcucaugaugcgcaccaccugggcccugugcgaggcccugacgcucgccaccgggcccaucuccacccugugggagggcaaccccgggcgguucuggaacaccacgaucgccgucagcauggcgaacaucuuccgcggcuccuaccuggccggcgccgggcuccuguucagcaucaugaagaacaccaccuccacccgccggggcacggggaacaucggcgagacccugggcgagaaguggaagucccgccucaacgcccuggggaaguccgaguuccagaucuacaagaaguccggcauccaggagguggaccggacccuggcgaaggaggggaucaagcgcggcgagaccgaccaccacgccgugucccgggggagcgccaagcuccgcugguucgucgagcggaacauggugacgccggagggcaagguggucgaccugggcugcgggcgcggcgggugguccuacuacugcggcgggcugaagaacgugcgggaggugaagggccucaccaagggcgggcccggccacgaggagcccauccccaugagcaccuacggguggaaccugguccgccugcagagcggcguggacguguucuucaccccgcccgagaagugcgacacgcuccugugcgacaucggggaguccagccccaaccccaccaucgaggccggccggacccugcgcguccucaaccugguggagaacuggcugaacaacaacacccaguucugcaucaaggugcucaacccguacaugcccuccgucaucgagaagauggaggcccugcagcggcaguacggcggggcgcuggugcgcaacccccucagccggaacuccacccacgagauguacugggugagcaacgccacgggcaacaucgucuccagcgugaacaugaucucccgcaugcugaucaaccgguucaccaugaagcacaagaaggccaccuacgagccggacguggaccuggggagcggcacccgcaacaucgggaucgaguccgagauccccaaccuggacaucaucggcaagcggaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccuccugaccaagcccugggacgucgugccgauggugacgcagauggcgaugaccgacaccacccccuucgggcagcagcgcgucuucaaggagaagguggacacgcggacccaggagcccaaggagggcaccaagaagcugaugaagaucaccgccgaguggcucuggaaggagcugggcaagaagaagacgccccgcaugugcacccgggaggaguucaccaagaaggugcgcuccaacgccgcccugggggccaucuucaccgacgagaacaaguggaaguccgcgcgggaggccgucgaggacggccgcuucugggagcucguggaccgggagcgcaaccugcaccuggaggggaagugcgagacgugcguguacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgggaacagccuguccggcgucgagggggagggccuccaccggcugggcuacauccugcgcgacguggggaagaaggagggcggggccauguacgccgacgacaccgccggcugggacacccggaucacccucgaggaccugaagaacgaggagauggucacgaaccacaugaagggggagcacaagaagcuggcggaggccaucuucaagcucaccuaccagaacaagguggugcgcguccagcggccgacgccccgcggcaccgugauggacaucaucagccggcgcgaccagcggggcuccgggcaggucggcaccuacgggcugaacaccuucaccaacauggaggcccagcugauccgccagauggagggcgagggcaucuucaagagcauccagcaccucaccgccacggaggagaucgccguccagaacuggcuggcgcgcguggggcgggagcgccugucccggauggccaucagcggcgacgacugcguggucaagcccaucgacgaccgcuucgccuccgcccucaccgcccugaacgacauggggaaggugcggaaggacauccagcagugggagcccagccgcggcuggaacgacuggacccaggugccguucugcucccaccacuuccacgagcuggucaugaaggacgggcgggugcucgugguccccugccgcaaccaggacgagcugaucggccgggcgcgcaucagccagggcgccggguggucccugaaggagaccgccugccucggcaagagcuacgcccagauguggacgcugauguacuuccaccggcgcgaccugcggcucgccgcgaacgccaucugcuccgccgugcccagccacugggugcccaccucccgcaccaccuggagcauccacgccaagcacgaguggaugaccacggaggacaugcuggcggucuggaaccggguguggauccaggagaacccguggauggaggacaagacccccguggaguccugggaggagguccccuaccuggggaagcgcgaggaccaguggugcggcagccucaucgggcugaccagccgggccaccugggccaagaacauccagacggccaucaaccaggugcgcucccugaucggcaacgaggaguacaccgacuacaugcccagcaugaagcgguuccgccgcgaggaggaggaggccggcgugcucugguga

SEQ ID NO: 9221 - RNA, 9876 nt, Artificial Sequence
  derived and/or modified CDS sequence (opt1) from DENV-2__FJ547090__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagagccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccaccaucaaggacaaccgggccgugcacgcggacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgccucggcuaccacacccagaccgccgggccguggcaccugggcaagcuggagauggacuucgacuucugcgaggggaccacgguggucgugaccgaggacugcggcaaccggggccccagccuccgcaccaccacggcgagcgggaagcugaucaccgaguggugcugccgguccugcacccugccgccccugcgcuaccggggcgaggacgggugcugguacggcauggagauccgcccgcugaaggagaaggaggagaaccuggugaacagccucgucaccgccgggcacggccagaucgacaacuucucccugggcgugcuggggauggcccucuuccuggaggagaugcugcggacgcgcaucggcaccaagcacgccauccuccugguggcggucagcuucgugacccugaucaccgggaacauguccuuccgggaccucggccgcgugauggucauggugggggccacgaugaccgacgacaucggcaugggcgugaccuaccuggcccugcucgccgccuucaagguccgccccaccuucgcggccgggcugcugcuccggaagcugacgagcaaggagcugaugauggccaccaucggcaucgcccuccugucccagagcaccauccccgagaccauccuggagcucacggacgcccuggcgcuggggaugauggugcucaagaucgugcgcaacauggagaaguaccagcuggccgucaccaucauggccaucuccugcgugcccaacgccgugauccugcagaacgccuggaaggucagcugcaccauccucgcggccguguccgucagcccgcugcugcucaccuccagccagcagaaggccgacuggaucccccuggcccugacgaucaagggccucaaccccaccgcgaucuuccugaccacccugucccggacgagcaagaagcgcuccuggccccucaacgaggccaucauggccgugggcauggugagcauccuggccuccagccugcucaagaacgacaucccgaugaccgggccccuggucgccggcgggcugcucaccgugugcuacgugcugaccggccggagcgcggaccuggagcucgagcgcgccgccgacgucaagugggaggaccaggccgagaucuccgggagcucccccauccugagcaucacgaucuccgaggacggcagcauguccaucaagaacgaggaggaggagcagacccugaccauccucauccggaccggccugcuggugaucagcgggguguuccccgucuccaucccgaucaccgccgcggccugguaccucugggaggugaagaagcagcgcgccggcgugcugugggacguccccuccccgccgcccguggagaaggccgagcuggaggacggggccuaccggaucaagcagcgcggcauccucggguacucccagaucggcgcgggcguguacaaggaggggacguuccacaccauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgccgugcagaccaagcccgggaucuucaagacgaacaccggcaccaucggggcggucagccucgacuucucccccggcaccagcggcucccccaucguggaccggaaggggaagguggucggccuguacgggaacggcguggugacgcgcagcggcgccuacgucuccgccaucgcccagaccgagaaguccaucgaggacaacccggagaucgaggacgacaucuuccggaagaagcgccugaccaucauggaccuccaccccggggcgggcaagaccaagcgguaccugcccgccaucgugcgcgaggccaucaagcgggggcugcgcacgcugauccucgcccccacccgcguggucgccgcggagauggaggaggcccugcggggccugccgauccgcuaccagacccccgccaucaagaccgagcacacggggcgggagaucguggaccucaugugccacgccaccuucaccaugcgccugcugagccccgugcggguccccaacuacaaccucaucaucauggacgaggcccacuucaccgacccggcguccaucgccgcccgcggcuacaucagcacgcggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggugaccgacuucaagggcaagacggucugguucgugcccuccaucaaggccgggaacgacaucgccgcgugccugcggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccgcggcgcugcaugaagcccgugauccucaccgacggggaggagcgggugauccuggccggccccaugcccgucacccacuccagcgcggcccagcgccgggggcgcaucggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgccaucgacggcgaguaccgccugcgcggggaggcgcgcaagacguucguggaccucaugcggcgcggcgaccugcccgucuggcuggccuacaagguggccgccgaggggaucaacuacgccgaccggaaguggugcuucgacggcaucaagaacaaccagauccucgaggagaacauggagguggagaucuggaccaaggagggggagcgcaagaagcugaagccccgguggcuggacgcgcgcaucuacagcgacccgcucgcccugaaggaguucaaggaguucgccgccggccggaagucccugacccucaaccugaucaccgagaugggccgccugcccacguucaugacccagaaggcgcggaacgcccucgacaaccuggccguccugcacaccgccgaggccgggggccgcgcguacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcccagauccagccccacuggaucgcggccuccaucauccuggaguucuuccucaucguccugcugaucccggagcccgagaagcagcggacgccccaggacaaccagcucaccuacguggugaucgccauccugaccgucguggccgccacgauggcgaacgagaugggcuuccuggagaagaccaagaaggaccucgggcugggcagcaucaccacccaggagagcgaguccaacauccuggacaucgaccuccgccccgccagcgccuggacgcuguacgccguggccaccaccuucgucaccccgaugcugcggcacuccaucgagaacagcuccgugaacgugagccucacggcgaucgccaaccaggccaccguccugaugggccuggggaagggcuggccccucuccaagauggacaucggggugccccugcuggccaucggcugcuacagccaggugaaccccaucacccucaccgcggcccugcugcuccuggucgcccacuacgccaucaucgggccgggccugcaggccaaggcgacgcgcgaggcccagaagcgggccgccgccggcaucaugaagaaccccaccguggacgggaucaccgugaucgaccucgagcccauccccuacgacccgaaguucgagaagcagcugggccaggucaugcugcucauccugugcgugacccaggugcugaugaugcgcacgaccugggcgcucugcgaggcccugacccuggccaccgggcccaucuccacgcucugggagggcaaccccgggcgguucuggaacaccaccaucgccgucagcauggccaacaucuuccgcggcuccuaccuggcgggcgccgggcuccucuucagcaucaugaagaacaccacguccacccgccggggcaccgggaacaucggcgagacccugggcgagaaguggaagucccgccugaacgcccucgggaaguccgaguuccagaucuacaagaaguccggcauccaggagguggaccggacgcuggccaaggaggggaucaagcgcggcgagaccgaccaccacgcggugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugaccaagggcgggccgggccacgaggagcccauccccaugagcacguacggguggaaccucguccgccugcagagcggcguggacguguucuucacgccgcccgagaagugcgacacccugcucugcgacaucggggaguccagccccaaccccaccaucgaggccggccggacccugcgcguccugaaccucguggagaacuggcugaacaacaacacgcaguucugcaucaaggugcugaaccccuacaugcccuccgucaucgagaagauggaggcccuccagcggcaguacggcggggcccuggugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagcccgacguggaccucgggagcggcacccgcaacaucgggaucgaguccgagaucccgaaccuggacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcucaccaagcccugggacgucgugcccauggugacccagauggccaugaccgacacgaccccguucgggcagcagcgcgucuucaaggagaagguggacacccggacccaggagcccaaggagggcacgaagaagcugaugaagaucaccgcggaguggcuguggaaggagcucggcaagaagaagacgccccgcaugugcacccgggaggaguucacgaagaaggugcgcuccaacgccgcccugggggccaucuucaccgacgagaacaaguggaaguccgcccgggaggcggucgaggacggccgcuucugggagcugguggaccgggagcgcaaccuccaccuggaggggaagugcgagaccugcguguacaacaugaugggcaagcgggagaagaagcugggggaguucggcaaggccaagggcucccgcgccaucugguacauguggcucggggcccgguuccuggaguucgaggcgcugggcuuccucaacgaggaccacugguucagccgcgggaacagccuguccggcgucgagggggagggccugcaccggcucggcuacauccugcgcgacguggggaagaaggagggcggggccauguacgccgacgacaccgccggcugggacacgcggaucacccuggaggaccucaagaacgaggagauggucaccaaccacaugaagggggagcacaagaagcuggccgaggcgaucuucaagcugaccuaccagaacaagguggugcgcguccagcggcccacgccgcgcggcaccgugauggacaucaucagccggcgcgaccagcggggcuccgggcaggucggcaccuacgggcucaacaccuucacgaacauggaggcccagcugauccgccagauggagggcgagggcaucuucaagagcauccagcaccugaccgccaccgaggagaucgccguccagaacuggcucgcccgcguggggcgggagcgccugucccggauggcgaucagcggcgacgacugcguggucaagcccaucgacgaccgcuucgccuccgcccugaccgcccucaacgacauggggaaggugcggaaggacauccagcagugggagcccagccgcggcuggaacgacuggacccaggugcccuucugcucccaccacuuccacgagcuggucaugaaggacgggcgggugcugguggucccgugccgcaaccaggacgagcucaucggccgggcccgcaucagccagggcgcgggguggucccugaaggagaccgccugccugggcaagagcuacgcccagauguggacccucauguacuuccaccggcgcgaccugcggcuggccgccaacgcgaucugcuccgccgugcccagccacugggugcccaccucccgcaccacguggagcauccacgccaagcacgaguggaugaccaccgaggacaugcucgccgucuggaaccggguguggauccaggagaaccccuggauggaggacaagaccccgguggaguccugggaggagguccccuaccuggggaagcgcgaggaccaguggugcggcagccugaucgggcucacgagccgggcgaccugggccaagaacauccagaccgccaucaaccaggugcgcucccugaucggcaacgaggaguacaccgacuacaugcccagcaugaagcgguuccgccgcgaggaggaggaggccggcgugcugugguga

SEQ ID NO: 9222 - RNA, 9876 nt, Artificial Sequence
  derived and/or modified CDS sequence (opt1) from DENV-2__EU482630__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugccccuuccuccgccagaacgagcccgaggacaucgacugcuggugcaacagcaccagcaccugggucaccuacgggaccugcaccaccacgggcgagcaccggcgcgagaagcgguccguggcccuggugccccacgucgggaugggccuggagacccgcaccgagaccuggaugagcagcgagggggccuggaagcacgugcagcggaucgagacguggauccuccgccacccgggcuucaccaucauggccgcgauccuggccuacaccaucgggaccacgcacuuccagcgggcccugaucuucauccuccugaccgccguggcgcccagcaugaccaugcgcugcaucggcaucagcaaccgggacuucgucgagggcgugagcgggggcagcuggguggacaucguccuggagcacgggagcugcgugaccacgauggccaagaacaagcccacccucgacuucgagcugaucaagaccgaggccaagcagcccgccacccugcgcaaguacugcaucgaggccaagcucacgaacaccaccaccgagagccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccucgaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccuggacuucaacgagaugguccuccugcagauggaggacaaggccuggcuggugcaccggcagugguuccucgaccugccccugcccuggcucccgggggccgacacccagggcagcaacuggauccagaaggagacgcuggugaccuucaagaacccccacgcgaagaagcaggacgucgugguccuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcuggggcgccucaucaccgugaacccgaucgucaccgagaaggacagccccgugaacaucgaggcggagccgcccuucggcgacuccuacaucaucaucgggguggagccgggccagcugaagcugaacugguucaagaaggggagcuccaucggccagauguucgagacgaccaugcgcggcgccaagcggauggccauccucggggacaccgccugggacuucggcagccucgggggcgucuucaccuccaucgggaaggcccugcaccagguguucggcgcgaucuacggcgccgccuucagcgggguguccuggacgaugaagauccucaucggcgucaucaucaccuggaucgggaugaacagccgcuccaccagccuguccgugagccuggugcuggucggcguggugacccucuaccugggggccgucgugcaggcggacuccggcugcguggucagcuggaagaacaaggagcugaagugcggcuccgggaucuucaucacggacaacgugcacaccuggaccgagcaguacaaguuccagcccgagagccccagcaagcucgccuccgccauccagaaggcccacgaggagggcaucugcgggauccggagcgugacccgccuggagaaccugauguggaagcagaucacgcccgagcucaaccacauccuguccgagaacgaggucaagcugaccaucaugaccggcgacaucaaggggaucaugcaggccggcaagcggagccuccgcccgcagcccaccgagcugaaguacuccuggaagacguggggcaaggcgaagaugcugagcaccgagucccacaaccagaccuuccucaucgacgggcccgagaccgccgagugcccgaacacgaaccgggccuggaacagccuggagguggaggacuacggcuucgggguguucaccaccaacaucuggcugaagcuccgcgagaagcaggacgucuucugcgacuccaagcugaugagcgccgccaucaaggacaaccgggcggugcacgccgacaugggcuacuggaucgaguccgcccugaacgacaccuggaagauggagaaggccagcuucaucgaggugaaguccugccacuggcccaagagccacacccucugguccaacggcguccuggagagcgagaugaucauccccaagaacuucgccgggcccgugucccagcacaacuaccgcccgggcuaccacacgcagaccgcggggcccuggcaccugggcaagcucgagauggacuucgacuucugcgaggggaccaccguggucgugacggaggacugcggcaaccggggccccagccugcgcaccaccaccgccagcgggaagcugaucacggaguggugcugccgguccugcacccugccgccccugcgcuaccggggcgaggacgggugcugguacggcauggagauccgcccccugaaggagaaggaggagaaccucgugaacagccuggucaccgccgggcacggccagaucgacaacuucucccugggcgugcucgggauggcccuguuccuggaggagaugcuccggacccgcaucggcacgaagcacgcgauccugcugguggccgucagcuucgugacccucaucaccgggaacauguccuuccgggaccugggccgcgugauggucauggugggggccaccaugacggacgacaucggcaugggcgugaccuaccuggcccuccuggccgcguucaagguccgccccaccuucgccgccgggcugcuccugcggaagcugaccagcaaggagcucaugauggccacgaucggcaucgcccugcugucccagagcaccauccccgagaccauccucgagcugaccgacgcgcuggcccucgggaugauggugcugaagaucgugcgcaacauggagaaguaccagcuggccgucacgaucauggccaucuccugcgugcccaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccggaccagcaagaagcgcuccuggccgcugaacgaggccaucauggccgugggcauggugagcauccuggccuccagccuccugaagaacgacauccccaugacggggccccuggucgcgggcgggcuccugaccgugugcuacgugcugaccggccggagcgccgaccucgagcuggagcgcgccgccgacgucaagugggaggaccaggccgagaucuccgggagcucccccauccugagcaucaccaucuccgaggacggcagcauguccaucaagaacgaggaggaggagcagacgcucaccauccugauccggaccggccugcucgugaucagcgggguguucccggucuccauccccaucaccgcggccgccugguaccugugggaggugaagaagcagcgcgccggcgugcugugggacguccccuccccgccgcccguggagaaggccgagcucgaggacggggcguaccggaucaagcagcgcggcauccugggguacucccagaucggcgccggcguguacaaggaggggaccuuccacacgauguggcacgucacccggggcgccgugcugaugcaccgcgggaagcggaucgagcccagcugggccgacgugaagaaggaccucaucuccuacggcgggggcuggaagcuggagggcgaguggaaggagggggaggagguccaggugcuggcccucgagcccggcaagaacccccgcgcggugcagaccaagcccgggaucuucaagaccaacacgggcaccaucggggccgucagccuggacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcuccgcacccugauccuggccccgacgcgcguggucgcggccgagauggaggaggcccugcggggccuccccauccgcuaccagacccccgccaucaagaccgagcacaccgggcgggagaucguggaccugaugugccacgccacguucaccaugcgccugcucagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcucagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccuggcgggccccaugccggucacccacuccagcgccgcccagcgccgggggcgcaucggccgcaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgggagaagguggacgcgaucgacggcgaguaccgccuccgcggggaggcccgcaagaccuucguggaccugaugcggcgcggcgaccugcccgucuggcucgccuacaagguggccgccgaggggaucaacuacgcggaccggaaguggugcuucgacggcaucaagaacaaccagauccuggaggagaacauggagguggagaucuggacgaaggagggggagcgcaagaagcugaagccgcgguggcucgacgcccgcaucuacagcgacccccuggcccugaaggaguucaaggaguucgccgcgggccggaagucccucacccugaaccugaucaccgagaugggccgccuccccaccuucaugacgcagaaggcccggaacgcccuggacaaccuggccguccuccacaccgccgaggccgggggccgcgccuacaaccacgcccugagcgagcugcccgagacccucgagacccugcugcuccugacgcugcucgccaccgugaccgggggcaucuuccuguuccugauguccggcaaggggaucggcaagaugacccucgggaugugcugcaucaucaccgccagcauccugcugugguacgcgcagauccagccgcacuggaucgccgccuccaucauccucgaguucuuccugaucguccugcucauccccgagcccgagaagcagcggacgccccaggacaaccagcugaccuacguggugaucgccauccugaccgucguggccgcgaccauggccaacgagaugggcuuccucgagaagacgaagaaggaccuggggcugggcagcaucaccacccaggagagcgaguccaacauccucgacaucgaccugcgcccggccagcgccuggacccuguacgccguggcgacgaccuucgucacccccaugcuccggcacuccaucgagaacagcuccgugaacgugagccugaccgccaucgccaaccaggccacgguccugaugggccucgggaagggcuggccccuguccaagauggacaucggggugccccugcucgcgaucggcugcuacagccaggugaacccgaucacccugaccgccgcccugcuccugcuggucgcccacuacgccaucaucgggcccggccuccaggcgaaggccacccgcgaggcccagaagcgggccgccgcgggcaucaugaagaaccccacgguggacgggaucaccgugaucgaccuggagcccaucccguacgaccccaaguucgagaagcagcugggccaggucaugcuccugauccugugcgugacccaggugcucaugaugcgcaccacgugggcccugugcgaggcccugacccucgccaccgggcccaucuccacccugugggagggcaaccccgggcgguucuggaacacgaccaucgccgucagcauggcgaacaucuuccgcggcuccuaccuggccggcgccgggcuccuguucagcaucaugaagaacaccaccuccacgcgccggggcaccgggaacaucggcgagacccugggcgagaaguggaagucccgccucaacgcccuggggaaguccgaguuccagaucuacaagaaguccggcauccaggagguggaccggacccuggcgaaggaggggaucaagcgcggcgagacggaccaccacgccgugucccgggggagcgccaagcuccgcugguucgucgagcggaacauggugaccccggagggcaagguggucgaccugggcugcgggcgcggcgggugguccuacuacugcggcgggcugaagaacgugcgggaggugaagggccucaccaagggcgggcccggccacgaggagcccauccccaugagcaccuacggguggaaccugguccgccugcagagcggcguggacguguucuucacgccgcccgagaagugcgacacccuccugugcgacaucggggaguccagccccaaccccaccaucgaggccggccggacccugcgcguccucaaccugguggagaacuggcugaacaacaacacccaguucugcaucaaggugcucaacccguacaugcccuccgucaucgagaagauggaggcccugcagcggcaguacggcggggcgcuggugcgcaacccccucagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccuggacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccuccugacgaagcccugggacgucgugccgauggugacccagauggcgaugaccgacaccacgcccuucgggcagcagcgcgucuucaaggagaagguggacacccggacccaggagcccaaggagggcaccaagaagcugaugaagaucacggccgaguggcucuggaaggagcugggcaagaagaagacgccccgcaugugcacccgggaggaguucaccaagaaggugcgcuccaacgccgcccugggggccaucuucacggacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgggaacagccuguccggcgucgagggggagggccuccaccggcugggcuacauccugcgcgacguggggaagaaggagggcggggccauguacgccgacgacaccgccggcugggacacccggaucacgcucgaggaccugaagaacgaggagauggucaccaaccacaugaagggggagcacaagaagcuggcggaggccaucuucaagcucaccuaccagaacaagguggugcgcguccagcggccgacgccccgcggcaccgugauggacaucaucagccggcgcgaccagcggggcuccgggcaggucggcaccuacgggcugaacaccuucaccaacauggaggcccagcugauccgccagauggagggcgagggcaucuucaagagcauccagcaccucacggccaccgaggagaucgccguccagaacuggcuggcgcgcguggggcgggagcgccugucccggauggccaucagcggcgacgacugcguggucaagcccaucgacgaccgcuucgccuccgcccucaccgcccugaacgacauggggaaggugcggaaggacauccagcagugggagcccagccgcggcuggaacgacuggacccaggugccguucugcucccaccacuuccacgagcuggucaugaaggacgggcgggugcucgugguccccugccgcaaccaggacgagcugaucggccgggcgcgcaucagccagggcgccggguggucccugaaggagacggccugccucggcaagagcuacgcccagauguggacccugauguacuuccaccggcgcgaccugcggcucgccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccuggggaagcgcgaggaccaguggugcggcagccucaucgggcugaccagccgggccacgugggccaagaacauccagaccgccaucaaccaggugcgcucccugaucggcaacgaggaguacaccgacuacaugcccagcaugaagcgguuccgccgcgaggaggaggaggccggcgugcucugguga

SEQ ID NO: 9223 - RNA, 9876 nt, Artificial Sequence
  derived and/or modified CDS sequence (opt1) from DENV-2__FJ882594__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaacauccuggagcucaccgacgcgcuggcccuggggaugaugguccucaagaucgugcggaacauggagaaguaccagcuggccgugaccaucauggccaucuccugcgucccgaacgccgugauccugcagaacgcguggaaggugagcugcacgauccucgccgccgucuccgugagcccccugcugcucaccuccagccagcagaaggccgacuggaucccccuggcgcugaccaucaagggccucaaccccaccgccaucuuccugacgacccugucccgcaccagcaagaagcgguccuggccgcucaacgaggccaucauggccgucggcauggugagcauccuggccuccagccugcucaagaacgacauccccaugaccgggccccugguggcgggcgggcugcucacggucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacccugacgauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacaccauguggcacgugacgcgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacaccggcacgaucggggccgugagccucgacuucucccccggcaccagcggcucccccaucgucgaccgcaaggggaagguggugggccuguacgggaacggcgucgugacccggagcggcgccuacguguccgccaucgcgcagaccgagaaguccaucgaggacaaccccgagaucgaggacgacaucuuccgcaagaagcggcugacgaucauggaccuccaccccggggccggcaagaccaagcgcuaccugcccgccaucguccgggaggccaucaagcgcgggcugcgcacccugauccucgccccgacccgggugguggcggccgagauggaggaggcccugcgcggccugcccauccgguaccagacgaccgccaucaagaccgagcacaccgggcgcgagaucgucgaccucaugugccacgccacguucaccaugcggcugcugagccccgugcgcgugcccaacuacaaccucaucaucauggacgaggcgcacuucaccgacccggccuccaucgccgcccggggcuacaucagcacccgcgucgagaugggcgaggccgcggggaucuucaugacggccacgccgcccggcucccgggaccccuucccgcagagcaacgcccccaucauggacgaggagcgcgagauccccgagcgguccuggaacagcgggcacgagugggugaccgacuucaagggcaagaccgugugguucguccccuccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccgcgccggugcaugaagcccgucauccucacggacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggacgaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccggcccgccagcgccuggacccuguacgccguggcgacgaccuucgugaccccgaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacccgggaggcccagaagcgcgccgccgcgggcaucaugaagaaccccacggucgacgggaucaccgugaucgaccucgagcccauccccuacgacccgaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggaggucgaccgcacccuggcgaaggaggggaucaagcggggcgagacggaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccaccuacggguggaaccucgugcggcugcagagcggcgucgacguguucuucacgcccccggagaagugcgacacccugcucugcgacaucggggagagcucccccaaccccaccaucgaggccggccgcacccugcgggugcugaaccucgucgagaacuggcugaacaacaacacccaguucugcaucaaggugcugaaccccuacaugccgagcgugaucgagaagauggaggcccuccagcgcaaguacggcggggcgcugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagcccgacguggaccucggguccggcacgcggaacaucgggaucgagagcgagaucccgaaccuggacaucaucggcaagcgcaucgagaagaucaagcaggagcacgaggccuccuggcacuacgaccaggaccaccccuacaagaccugggccuaccacggcagcuacgagaccaagcagaccggguccgcgagcuccauggugaacggcgucgugcgccugcucacgaagcccugggacgugguccccauggugacccagauggccaugaccgacaccacgccguucgggcagcagcggguguucaaggagaaggucgacacccgcacccaggagcccaaggagggcaccaagaagcugaugaagaucacggccgaguggcuguggaaggagcucggcaagaagaagacgccccggaugugcacccgcgaggaguucaccaagaaggugcggagcaacgccgcccugggggcgaucuucacggacgagaacaaguggaaguccgcccgcgaggccguggaggacggccgguucugggagcuggucgaccgcgagcggaaccuccaccuggaggggaagugcgagaccugcguguacaacaugaugggcaagcgcgagaagaagcugggggaguucggccgggccaagggcagccgcgcgaucugguacauguggcucggggcccgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgcgggcugggacacccggaucacgcuggaggaccucaagaacgaggagauggugaccaaccacaugaagggggagcacaagaagcuggccgaggccaucuucaagcugaccuaccagaacaaggucgugcgcgugcagcggcccaccccgcgcggcacggucauggacaucaucucccggcgcgaccagcgcggcagcgggcaggucggcaccuacgggcucaacaccuucaccaacauggaggcccagcugauccggcagauggagggcgagggcaucuucaaguccauccagcaccugacggccaccgaggagaucgcggugcagaacuggcucgcccgcgucgggcgggagcgccugagccggauggccaucuccggcgacgacugcguggugaagcccaucgacgaccgcuucgccagcgcccugaccgcgcucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcccgcaucucccagggcgccggguggagccugaaggagacggccugccugggcaaguccuacgcccagauguggacccucauguacuuccaccggcgcgaccugcggcuggcggccaacgccaucugcagcgccguccccucccacugggugcccaccagccgcaccaccugguccauccacgcgaagcacgaguggaugacgaccgaggacaugcucgccguguggaaccgggucuggauccaggagaaccccuggauggaggacaagaccccgguggagagcugggaggaggugcccuaccuggggaagcgcgaggaccaguggugcggcucccugaucgggcucaccagccgggccacgugggccaagaacauccagaccgccaucaaccagguccgcagccugaucggcaacgaggaguacaccgacuacaugcccuccaugaagcgcuuccggcgcgaggaggaggaggcgggcgugcugugguga

SEQ ID NO: 9224 - RNA, 9876 nt, Artificial Sequence
  derived and/or modified CDS sequence (opt1) from DENV-2__FJ205885__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguccucaccuccaucgggaaggcccugcaccagguguucggcgcgaucuacggcgccgccuucagcgggguguccuggacgaugaagauccugaucggcgucaucaucaccuggaucgggaugaacagccgcuccaccagccuguccgugagccucgugcuggucggcguggugacccuguaccucggggccgucgugcaggcggacuccggcugcguggucagcuggaagaacaaggagcugaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccucgagaaccugauguggaagcagaucacgcccgagcugaaccacauccucuccgagaacgaggucaagcugaccaucaugaccggcgacaucaaggggaucaugcaggccggcaagcggagccugcgcccgcagcccaccgagcucaaguacuccuggaagacguggggcaaggcgaagaugcugagcaccgagucccacaaccagaccuuccugaucgacgggcccgagaccgccgagugcccgaacacgaaccgggccuggaacagccucgagguggaggacuacggcuucgggguguucaccaccaacaucuggcugaagcugcgcgagaagcaggacgucuucugcgacuccaagcucaugagcgccgccaucaaggacaaccgggcggugcacgccgacaugggcuacuggaucgaguccgcccugaacgacaccuggaagauggagaaggccagcuucaucgaggugaaguccugccacuggcccaagagccacacccugugguccaacggcguccucgagagcgagaugaucauccccaagaacuucgccgggcccgugucccagcacaacuaccgcccgggcuaccacacgcagaccgcggggcccuggcaccugggcaagcuggagauggacuucgacuucugcgaggggaccaccguggucgugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcaucggcacgaagcacgcgauccuccugguggccgucagcuucgugacccugaucaccgggaacauguccuuccgggaccucggccgcgugauggucauggugggggccaccaugacggacgacaucggcaugggcgugaccuaccuggcccugcucgccgcguucaagguccgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucgugcgcaacauggagaaguaccagcuggccgucacgaucauggccaucuccugcgugccgaacgccgugauccugcagaacgcguggaaggucagcugcaccauccucgccgccguguccgucagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgugggcauggugagcauccuggccuccagccugcucaagaacgacauccccaugacggggccccuggucgcgggcgggcugcucaccgugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacgcugaccauccucauccggaccggccugcuggugaucagcgggguguucccggucuccauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacucccagaucggcgccggcguguacaaggaggggaccuuccacacgauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagaccaagcccgggaucuucaagaccaacacgggcaccaucggggccgucagccucgacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgccccgacgcgcguggucgcggccgagauggaggaggcccugcggggccugcccauccgcuaccagacccccgccaucaagaccgagcacaccgggcgggagaucguggaccucaugugccacgccacguucaccaugcgccugcugagccccgugcgggucccgaacuacaaccucaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccucacggacggggaggagcgggugauccuggcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgcgaucgacggcgaguaccgccugcgcggggaggcccgcaagaccuucguggaccucaugcggcgcggcgaccugcccgucuggcuggccuacaagguggccgccgaggggaucaacuacacggaccggaaguggugcuucgacggcaucaagaacaaccagauccucgaggagaacauggagguggagaucuggaccaaggagggggagcgcaagaagcugaagccgcgguggcuggacgcgcgcaucuacagcgacccccucgcccugaaggaguucaaggaguucgccgccggccggaagucccugacccucaaccugaucaccgagaugggccgccugcccacguucaugacccagaaggcgcggaacgcccucgacaaccuggccguccugcacaccgccgaggccgggggccgcgcguacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcccagauccagccgcacuggaucgcggccuccaucauccuggaguucuuccucaucguccugcugauccccgagcccgagaagcagcggacgccccaggacaaccagcucaccuacguggugaucgccauccugaccgucguggccgccacgauggcgaacgagaugggcuuccuggagaagaccaagaaggaccucgggcugggcagcaucaccacccaggagagcgaguccaacauccuggacaucgaccuccgcccggccagcgccuggacgcuguacgccguggccaccaccuucgucacccccaugcugcggcacuccaucgagaacagcuccgugaacgugagccucacggcgaucgccaaccaggccaccguccugaugggccuggggaagggcuggccccucuccaagauggacaucggggugccccugcuggccaucggcugcuacagccaggugaacccgaucacccucaccgcggcccugcugcuccuggucgcccacuacgccaucaucgggcccggccugcaggccaaggcgacgcgcgaggcccagaagcgggccgccgccggcaucaugaagaaccccaccguggacgggaucaccgugaucgaccucgagcccaucccguacgaccccaaguucgagaagcagcugggccaggucaugcugcucauccugugcgugacccaggugcugaugaugcgcacgaccugggcgcucugcgaggcccugacccuggccaccgggcccaucuccacgcucugggagggcaaccccgggcgguucuggaacaccaccaucgccgucagcauggccaacaucuuccgcggcuccuaccuggcgggcgccgggcuccuguucagcaucaugaagaacaccacguccacccgccggggcaccgggaacaucggcgagacccugggcgagaaguggaagucccgccugaacgcccucgggaaguccgaguuccagaucuacaagaaguccggcauccaggagguggaccggacgcuggccaaggaggggaucaagcgcggcgagaccgaccaccacgcggugucccgggggagcgccaagcugcgcugguucgucgagcggaacauggugaccccggagggcaagguggucgaccucggcugcgggcgcggcgggugguccuacuacugcggcgggcugaagaacgugcgggaggugaagggccugaccaagggcgggcccggccacgaggagcccauccccaugagcacguacggguggaaccucguccgccugcagagcggcguggacguguucuucaccccgcccgagaagugcgacacccugcucugcgacaucggggaguccagccccaaccccaccaucgaggccggccggacccugcgcguccugaaccucguggagaacuggcugaacaacaacacgcaguucugcaucaaggugcugaacccguacaugcccuccgucaucgagaagauggaggcccuccagcggcaguacggcggggcccuggugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagccggacguggaccucgggagcggcacccgcaacaucgggaucgaguccgagauccccaaccuggacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcucaccaagcccugggacgucgugccgauggugacccagauggccaugaccgacacgacccccuucgggcagcagcgcgucuucaaggagaagguggacacccggacccaggagcccaaggagggcacgaagaagcugaugaagaucaccgcggaguggcuguggaaggagcucggcaagaagaagacgccccgcaugugcacccgggaggaguucacgcgcaaggugcgguccaacgccgcccugggggccaucuucaccgacgagaacaaguggaaguccgcccgcgaggcggucgaggacggccgguucugggagcugguggaccgcgagcggaaccuccaccuggaggggaagugcgagaccugcguguacaacaugaugggcaagcgcgagaagaagcugggggaguucggcaaggccaagggcucccgggccaucugguacauguggcucggggcccgcuuccuggaguucgaggcgcugggcuuccucaacgaggaccacugguucagccgggggaacagccuguccggcgucgagggggagggccugcaccgccucggcuacauccugcgggacguggggaagaaggagggcggggccauguacgccgacgacaccgccggcugggacacgcgcaucacccuggaggaccucaagaacgaggagauggucaccaaccacaugaagggggagcacaagaagcuggccgaggcgaucuucaagcugaccuaccagaacaagguggugcggguccagcgcccgacgccccggggcaccgugauggacaucaucagccgccgggaccagcgcggcuccgggcaggucggcaccuacgggcucaacaccuucacgaacauggaggcccagcugauccgccagauggagggcgagggcaucuucaagagcauccagcaccugaccgccaccgaggagaucgccguccagaacuggcucgcccggguggggcgcgagcggcugucccgcauggcgaucagcggcgacgacugcguggucaagcccaucgacgaccgguucgccuccgcccugaccgcccucaacgacauggggaaggugcgcaaggacauccagcagugggagcccagccggggcuggaacgacuggacccaggugccguucugcucccaccacuuccacgagcuggucaugaaggacgggcgcgugcuggugguccccugccggaaccaggacgagcucaucggccgcgcccggaucagccagggcgcgggguggucccugaaggagaccgccugccugggcaagagcuacgcccagauguggacccucauguacuuccaccgccgggaccugcgccuggccgccaacgcgaucugcuccgccgugcccagccacugggugcccaccucccggaccacguggagcauccacgccaagcacgaguggaugaccaccgaggacaugcucgccgucuggaaccgcguguggauccaggagaacccguggauggaggacaagacccccguggaguccugggaggagguccccuaccuggggaagcgggaggaccaguggugcggcagccugaucgggcucacgagccgcgcgaccugggccaagaacauccagaccgccaucaaccaggugcggucccugaucggcaacgaggaguacaccgacuacaugcccagcaugaagcgcuuccgccgggaggaggaggaggccggcgugcugugguga

SEQ ID NO: 9225 - RNA, 9876 nt, Artificial Sequence
  derived and/or modified CDS sequence (opt1) from DENV-2__FJ744743__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccggcaaggacagccccgugaacaucgaggcggagccgcccuucggggacuccuacaucaucaucggcguggagccggggcagcugaagcucaacugguucaagaagggcagcuccaucggccagauguucgagacgaccaugcgcggggccaagcggauggccauccugggcgacaccgccugggacuucgggagccugggcggggucuucaccuccaucggcaaggcccuccaccagguguucggcgcgaucuacggggccgccuucagcggcguguccuggacgaugaagauccugaucggggucaucaucaccuggaucggcaugaacagccgcuccaccagccuguccgugagccuggugcucgucgggguggugacccuguaccugggcgccgucgugcaggcggacuccggcugcguggucagcuggaagaacaaggagcucaagugcggguccggcaucuucaucacggacaacgugcacaccuggaccgagcaguacaaguuccagcccgagagccccagcaagcuggccuccgccauccagaaggcccacgaggaggggaucugcggcauccggagcgugacccgccuggagaaccucauguggaagcagaucacgcccgagcugaaccacauccuguccgagaacgaggucaagcucaccaucaugaccggggacaucaagggcaucaugcaggccggcaagcggagccuguggccgcagcccaccgagcugaaguacuccuggaagacgugggggaaggcgaagaugcucagcaccgagucccacaaccagaccuuccugaucgacggccccgagaccgccgagugcccgaacacgaaccgcgccuggaacagccuggagguggaggacuacggguucggcguguucaccaccaacaucuggcucaagcugcgggagaagcaggacgucuucugcgacuccaagcugaugagcgccgccaucaaggacaaccgcgcggugcacgccgacaugggcuacuggaucgaguccgcccucaacgacaccuggaagauggagaaggccagcuucaucgaggugaaguccugccacuggcccaagagccacacccugugguccaacgggguccuggagagcgagaugaucauccccaagaacuucgccggccccgugucccagcacaacuaccggccgggguaccacacgcagaccgcgggccccuggcaccucgggaagcuggagauggacuucgacuucugcgagggcaccaccguggucgugacggaggacugcggcaaccgcgggcccagccugcggaccaccaccgccagcggcaagcucaucacggaguggugcugccgcuccugcacccugcccccgcugcgguaccgcggggaggacggcugcugguacgggauggagauccggccccucaaggagaaggaggagaaccuggugaacagccuggucaccgccggccacggccagaucgacaacuucucccucggggugcugggcauggcccuguuccucgaggagaugcugcgcacccggaucgggacgaagcacgcgauccugcucguggccgucagcuucgugacccugaucaccggcaacauguccuuccgcgaccuggggcgggugauggucauggugggcgccaccaugacggacgacaucggcaugggggugaccuaccucgcccugcuggccgcguucaagguccgccccaccuucgccgccggccuccugcugcgcaagcucaccagcaaggagcugaugauggccacgaucgggaucgcccugcucucccagagcaccauccccgagaccauccuggagcugaccgacgcgcucgcccugggcaugauggugcugaagaucgugcggaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccguggggauggugagcauccucgccuccagccugcugaagaacgacauccccaugacgggcccccucgucgccggcgggcugcugaccgugugcuacgugcucaccgggcgcagcgccgaccuggagcuggagcgggccgccgacgucaagugggaggaccaggccgagaucuccgggagcucccccauccucagcaucaccaucuccgaggacggcagcauguccaucaagaacgaggaggaggagcagacgcugaccauccugauccgcaccgggcuccuggugaucagcggcguguucccggucuccauccccaucaccgcggccgccugguaccugugggaggugaagaagcagcgggccggggugcucugggacguccccagcccgccgcccguggagaaggccgagcuggaggacggcgcguaccgcaucaagcagcgggggauccugggcuacucccagaucggcgccgggguguacaaggagggcaccuuccacacgauguggcacgucacccgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggcggugcagaccaagcccggcaucuucaagaccaacacggggaccaucggcgccgucagccuggacuucucccccggcaccagcgggucccccaucguggaccgcaagggcaagguggucgggcucuacggcaacggcguggugacccggagcggggccuacgucuccgccaucgcgcagacggagaaguccaucgaggacaaccccgagaucgaggacgacaucuuccgcaagaagcggcugaccaucauggaccugcaccccggcgccgggaagaccaagcgcuaccuccccgccaucgugcgggaggccaucaagcgcggccugcggacccugauccuggccccgacgcgcguggucgcggccgagauggaggaggcccuccgcgggcugcccauccgguaccagacccccgccaucaagaccgagcacaccggccgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgucugguucgugccguccaucaaggccggcaacgacaucgcggccugccuccgcaagaacggcaagaaggugauccagcugagccggaagacguucgacuccgaguacgucaagacccgcgccaacgacugggacuucguggugaccaccgacaucagcgagaugggggccaacuucaaggccgagcgggucaucgacccccgccggugcaugaagcccgugauccugacggacggcgaggagcgcgugauccucgcggggcccaugccggucacccacuccagcgccgcccagcggcgcggccggaucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaagguggacgcgaucgacggggaguaccggcugcgcggcgaggcccggaagaccuucguggaccugaugcgccgcggggaccuccccgucuggcuggccuacaagguggccgccgagggcaucaacuacgcggaccgcaaguggugcuucgacgggaucaagaacaaccagauccuggaggagaacauggagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcauccugcucugguacgcgcagauccagccgcacuggaucgccgccuccaucauccuggaguucuuccugaucguccuccugauccccgagcccgagaagcagcgcacgccccaggacaaccagcugaccuacguggugaucgccauccucaccgucguggccgcgaccauggccaacgagaugggguuccuggagaagacgaagaaggaccugggccucggcagcgugaccacccaggagagcgaguccaacauccuggacaucgaccugcggccggccagcgccuggacccucuacgccgucgcgacgaccuucgugacccccaugcugcgccacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccacccuccugcgguucguggcccaguacgccaucaucggccccggccugcaggccaaggcgacgcgcgaggcccagaagcgggccgccgccgggaucaugaagaaccccaccguggacggcaucaccgucaucgaccucgagcccaucccguacgaccccaaguucgagaagcagcuggggcaggucaugcugcucauccugugcgugacccagguccugaugaugcgcacgaccugggcgcucugcgaggcccugacccuggccaccggccccaucuccacgcucugggaggggaaccccggccgguucuggaacaccaccaucgccgugagcauggccaacaucuuccgcggcuccuaccuggcgggggccggccuccucuucagcaucaugaagaacaccacguccacccgccgggggaccggcaacaucggcgagacccugggggagaaguggaagucccgccugaacgcccucggcaaguccgaguuccagaucuacaagaaguccgggauccaggagguggaccggacgcuggccaaggagggcaucaagcgcggggagaccgaccaccacgcggucucccggggcagcgccaagcugcgcugguucguggagcggaacauggugaccccggagggcaaggucguggaccucgggugcggccgcgggggcugguccuacuacugcgggggccugaagaacgugcgggaggucaagggccugaccaagggcgggcccgggcacgaggagcccauccccaugagcacguacggcuggaaccucgugcgccugcagagcgggguggacgucuucuucaccccgcccgagaagugcgacacccugcucugcgacaucggcgaguccagccccaaccccaccaucgaggccggccggacccugcgcgugcugaaccucguggagaacuggcugaacaacaacacgcaguucugcaucaagguccugaacccguacaugcccuccgugaucgagaagauggaggcccuccagcggcaguacgggggcgcccuggugcgcaacccccugagccggaacuccacccacgagauguacugggucagcaacgcgaccgggaacaucguguccagcgugaacaugaucucccgcaugcucaucaaccgguucaccaugaagcacaagaaggccacguacgagccggacgucgaccugggcagcgggacccgcaacaucggcaucgaguccgagauccccaaccuggacaucaucggcaagcggaucgagaagaucaagcaggagcacgagaucagcuggcacuacgaccaggaccaccccuacaagaccugggccuaccacggguccuacgagaccaagcagacgggcagcgccuccagcauggugaacggggugguccgccugcucaccaagcccugggacguggugccgauggucacccagauggccaugaccgacacgacccccuucggccagcagcgcguguucaaggagaagguggacacccggacccaggagcccaaggagggcacgaagaagcugaugaagaucaccgcggaguggcuguggaaggagcucgggaagaagaagacgccccgcaugugcacccgggaggaguucacgaagaagguccgcuccaacgccgcccugggcgccaucuucaccgacgagaacaaguggaaguccgcccgggaggcgguggaggacgggcgcuucugggagcugguggaccgggagcgcaaccuccaccuggagggcaagugcgagaccugcgucuacaacaugauggggaagcgggagaagaagcugggcgaguucggcaaggccaaggggucccgcgccaucugguacauguggcucggcgcccgguuccuggaguucgaggcgcugggguuccucaacgaggaccacugguucagccgcggcaacagccuguccgggguggagggcgagggccugcaccggcucggguacauccugcgcgacgucggcaagaaggagggcggggccauguacgccgacgacaccgccgggugggacacgcggaucacccuggaggaccucaagaacgaggagauggugaccaaccacaugaagggcgagcacaagaagcuggccgaggcgaucuucaagcugaccuaccagaacaaggugguccgcgugcagcggccgacgccccgcggcaccgugauggacaucaucagccggcgcgaccagcggggguccggccaggucgggaccuacggccucaacaccuucacgaacauggaggcccagcugauccgccagauggagggcgaggggaucuucaagagcauccagcaccugaccgccaucgaggagaucgccgugcagaacuggcucgcccgcgugggccgggagcgccugucccggauggcgaucagcggggacgacugcgucgugaagcccaucgacgaccgcuucgccuccgcccugaccgcccucaacgacaugggcaaggugcggaaggacauccagcagugggagcccagccgcggguggaacgacuggacccaggucccguucugcucccaccacuuccacgagcuggugaugaaggacggccgggugcuggucgugcccugccgcaaccaggacgagcucaucggccgggcccgcaucagccagggggcgggcuggucccugaaggagacggccugccugggcaagagcuacgcccagauguggacccucauguacuuccaccggcgcgaccugcggcuggccgccaacgcgaucugcuccgccgugcccagccacuggguccccaccucccgcaccaccuggagcauccacgccaagcacgaguggaugacgaccgaggacaugcucgccguguggaaccggguguggauccaggagaacccguggauggaggacaagacccccgucgaguccugggaggaggugcccuaccugggcaagcgcgaggaccaguggugcgggagccugaucggccucaccagccgggcgacgugggccaagaacauccagaccgccaucaaccaggugcgcucccugaucggcaacgaggaguacaccgacuacaugcccagcaugaagcgguuccgccgcgaggaggaggaggccgggguccugugguga

SEQ ID NO: 9226 - RNA, 9876 nt, Artificial Sequence
  derived and/or modified CDS sequence (opt1) from DENV-2__JN819424__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccuccagcaucgacaaccgggccgugcacgcggacaugggcuacuggauggaguccgcccccagcgacuccugcaagauggagaaggccagcuucaucgaggacaaguccugcuacuggcccaacagccagcaccucuggagcaacggcgugcuggaguccgagaugaucuuccccaagaacuucgccgggccggucagccagcacaucuaccgccccggcuaccacacccagaccgccgggcccugcaaccugggcaagcucgagauggacuucgacuucugcgaggggacgaccgugguggucaccgaggacugcggcaaccggggccccucccugcgcaccacgaccgcgagcgggaagcugaucaccgaguggugcugccgguccugcacccucccgccccugcgcuaccggggcgaggacgggugcugguacggcauggagauccgcccccugaaggagaaggaggagaaccucgugaacagccuggugacggccgggcacggccagaucgacaacuucucccugggcguccucgggauggcccuguuccuggaggagaugcuccggacccgcaucggcaccaagcacgccauccugcugguggcggugagcuucgucacccucaucacggggaacauguccuuccgggaccugggccgcgugauggugauggucggggccaccaugaccgacgacaucggcaugggcgugaccuaccuggcccuccuggccgccuucaaggugcgccccacguucgcggccgggcugcuccugcggaagcugaccagcaaggagcucaugauggccaccaucggcaucgcccugcugucccagagcaccaucccggagacgauccucgagcugaccgacgcccuggcgcucgggaugaugguccugaagaucgugcgcaacauggagaaguaccagcuggccgugaccaucauggccaucuccugcguccccaacgccgugauccuccagaacgccuggaaggugagcugcaccauccuggcggccgucuccgugagcccccugcuccugacguccagccagcagaaggccgacuggaucccccuggcccucaccaucaagggccugaacccgaccgcgaucuuccugaccacgcucucccggaccagcaagaagcgcagcuggccccugaacgaggccaucauggccgucggcaugguguccauccuggccagcucccuccugaagaacgacauccccaugaccgggccccugguggccggcgggcuccugaccgucugcuacgugcugacgggccggagcgcggaccucgagcuggagcgcgccgccgacgugaagugggaggaccaggccgagaucuccgggagcuccccgauccugagcaucaccaucuccgaggacggcagcauguccaucaagaacgaggaggaggagcagacccucaccauccugauccggacgggccugcucgucaucagcgggguguuccccguguccauccccaucaccgccgcggccugguaccugugggaggucaagaagcagcgcgccggcgugcugugggacgugcccagcccgccgcccgucgagaaggccgagcucgaggacggggccuaccggaucaagcagcgcggcauccugggguacucccagaucggcgcgggcguguacaaggaggggaccuuccacaccauguggcacgugacccggggcgccguccugaugcaccgcgggaagcggaucgagccgagcugggccgacgugaagaaggaccucaucuccuacggcgggggcuggaagcuggagggcgaguggaaggagggggaggaggugcagguccuggcccucgagcccggcaagaacccccgcgccgugcagacgaagcccgggaucuucaagaccaacaccggcaccaucggggcggugagccuggacuucuccccgggcacgagcggcagccccaucgucgaccggaaggggaagguggugggccuguacgggaacggcgucgugacccgcuccggcgccuacgugagcgccaucgcccagaccgagaaguccaucgaggacaaccccgagaucgaggacgacaucuuccggaagaagcgccucaccaucauggaccugcaccccggggcgggcaagacgaagcgguaccugccggccaucguccgcgaggccaucaagcgggggcuccgcacccugauccuggcccccacccgcgugguggccgcggagauggaggaggcccugcggggccuccccauccgcuaccagacccccgccaucaagacggagcacaccgggcgggagaucgucgaccugaugugccacgccaccuucaccaugcgccugcucagcccggugcgggugcccaacuacaaccugaucaucauggacgaggcccacuucacggaccccgcguccaucgccgcccgcggcuacaucagcacccgggucgagaugggcgaggccgccgggaucuucaugaccgcgacgccgcccggcucccgcgaccccuucccccagagcaacgcccccaucauggacgaggagcgggagauccccgagcgcuccuggaacagcgggcacgagugggugacggacuucaagggcaagaccgugugguucguccccuccaucaaggccgggaacgacaucgccgcgugccugcggaagaacggcaagaaggugauccagcucagccgcaagaccuucgacuccgaguacgugaagacccgggccaacgacugggacuucgucgugacgaccgacaucagcgagaugggcgccaacuucaaggccgagcgcgugaucgacccccggcgcugcaugaagcccgucauccugaccgacggggaggagcgggugauccuggccggcccgaugcccgugacccacuccagcgcggcccagcgccgggggcgcaucggccgcaaccccaagaacgagaacgaccaguacaucuacaugggggagccccucgagaacgacgaggacugcgcccacuggaaggaggccaagaugcugcuggacaacaucaacacgccggagggcaucauccccuccauguucgagcccgagcgggagaaggucgaggccaucgacggcgaguaccgccuccgcggggaggcgcgcaagaccuucguggaccugaugcggcgcggcgaccugccggugcggcucgccuacaaggucgccgccgaggggaucaacuacgccgaccgcaaguggugcuucgacggcaucaagaacagccagauccuggaggagaacauggagguggagaucuggaccaaggagggggagcggaagaagcugaagccccgcuggcucgacgcgcggaucuacuccgacccccuggcccugaaggaguucaaggaguucgccgccggccgcaagagccucacccugaaccugaucacggagaugggccggcuccccaccuucaugacccagaaggcgcgcaacgcccuggacaaccuggccgugcuccacaccgccgaggccgggggccgggcguacaaccacgcccugagcgagcugccggagacgcucgagacccugcugcuccugacccugcucgccaccgucaccgggggcaucuuccuguuccugauguccggcaaggggaucggcaagaugacccucgggaugugcugcaucaucaccgccagcauccugcugugguacgcccagauccagccccacuggaucgcggccuccaucauccucgaguucuuccugaucgugcugcucauccccgagcccgagaagcagcgcaccccgcaggacaaccagcugaccuacgucgugaucgccauccugacgguggucgccgccaccauggcgaacgagaugggcuuccucgagaagaccaagaaggaccuggggcugggcagcaucaccacgcaggaguccgagagcaacauccucgacaucgaccugcggcccgccuccgccuggacccuguacgccguggccaccaccuucgugacgcccaugcuccgccacagcaucgagaacuccagcgucaacgugucccugaccgcgaucgccaaccaggccaccgugcugaugggccucgggaagggcuggccccugagcaagauggacaucggggucccgcugcucgccaucggcugcuacucccaggugaaccccaucacccugacggcggcccugcuccugcugguggcccacuacgccaucaucgggcccggccuccaggccaaggcgacccgggaggcccagaagcgcgccgccgccggcaucaugaagaaccccaccgucgacgggaucaccgugaucgaccuggagccgauccccuacgaccccaaguucgagaagcagcugggccaggugaugcuccugauccugugcgucacccagguccucaugaugcggaccaccugggcgcugugcgaggcccugacccucgccacggggcccaucagcacccugugggagggcaacccggggcgcuucuggaacaccaccaucgccguguccauggccaacaucuuccgcggcagcuaccuggcgggcgccgggcuccuguucuccaucaugaagaacacgaccagcacccggcgcggcaccgggaacaucggcgagacgcugggcgagaaguggaagucccggcucaacgcccugggcaagagcgaguuccagaucuacaagaaguccggcauccaggaggucgaccgcacccuggccaaggaggggaucaagcggggcgagaccgaccaccacgcggugucccgcgggagcgccaagcuccggugguucguggagcgcaacauggucacccccgagggcaaggugguggaccugggcugcgggcggggcgggugguccuacuacugcggcgggcugaagaacguccgcgaggugaagggccucacgaagggcgggcccggccacgaggagcccaucccgaugagcaccuacggguggaaccuggugcggcugcaguccggcgucgacguguucuucacgccgcccgagaagugcgacacccuccugugcgacaucggggagagcucccccaacccgacgaucgaggccggccgcacccugcgggugcucaaccuggucgagaacuggcugaacaacaacacccaguucugcaucaaggugcucaaccccuacaugcccagcgugaucgagaagauggaggcccugcagcgccaguacggcggggcccugguccggaacccgcucucccgcaacagcacccacgagauguacuggguguccaacgcgaccggcaacaucgugagcuccgucaacaugaucagccggaugcugaucaaccgcuucacgaugaagcacaagaaggccaccuacgagcccgacguggaccugggguccggcacccggaacaucgggaucgagagcgagauccccaaccuggacaucaucggcaagcgcaucgagaagaucaagcaggagcacgagaucuccuggcacuacgaccaggaccaccccuacaagaccugggccuaccacggcagcuacgagacgaagcagaccggguccgccagcagcauggugaacggcgucgugcgccuccugaccaagccgugggacgugguccccauggugacccagauggccaugacggacaccacccccuucgggcagcagcggguguucaaggagaaggucgacacccgcacgcaggagcccaaggagggcaccaagaagcugaugaagaucaccgcggaguggcucuggaaggagcugggcaagaagaagaccccgcggaugugcacgcgcgaggaguucaccaagaaggugcgguccaacgccgcccugggggccaucuucaccgacgagaacaaguggaaguccgcccgcgaggcgguggaggacggccgguucugggagcucgucgaccgcgagcggaaccugcaccuggaggggaagugcgagaccugcguguacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggggaacucccugagcggcguggagggggagggccuccaccgccugggcuacauccugcgggacgucgggaagaaggagggcggggccauguacgccgacgacacggccggcugggacacccgcaucacccucgaggaccugaagaacgaggagauggugaccaaccacaugaagggggagcacaagaagcuggccgaggcgaucuucaagcucacguaccagaacaaggucgugcgggugcagcgccccacgccccggggcaccgucauggacaucaucucccgccgggaccagcgcggcagcggccaggugggcaccuacgggcugaacacguucaccaacauggaggcccagcugauccgccagauggagggcgagggcaucuucaaguccauccagcaccucaccgccaccgaggagaucgccgugcagaacuggcuggcccgggucgggcgcgagcggcugagccgcauggcgaucuccggcgacgacugcguggugaagcccaucgacgaccgguucgccagcgcccucacggcccugaacgacauggggaagguccgcaaggacauccagcagugggagccgucccggggcuggaacgacuggacccaggugcccuucugcagccaccacuuccacgagcuggugaugaaggacgggcgcguccucguggugcccugccggaaccaggacgagcugaucggccgcgcccggaucucccagggcgcgggguggagccugaaggagaccgccugccucggcaaguccuacgcccagauguggacccugauguacuuccaccgccgggaccugcgccucgccgccaacgcgaucugcagcgccguccccagccacugggugccgacgucccggaccaccuggagcauccacgccaagcacgaguggaugaccaccgaggacaugcuggccguguggaaccgcgucuggauccaggagaaccccuggauggaggacaagacgcccguggaguccugggaggaggugcccuaccuggggaagcgggaggaccaguggugcggcagccucaucgggcugaccucccgcgcgaccugggccaagaacauccagaccgccaucaaccagguccggagccugaucggcaacgaggaguacacggacuacaugccguccaugaagcgcuuccgccgggaggaggaggaggccggcgugcucugguga

SEQ ID NO: 9227 - RNA, 9876 nt, Artificial Sequence
  derived and/or modified CDS sequence (opt1) from DENV-2__FJ744741__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggcgcgugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgcgggcugcggacccugauccucgccccgacgcgcgugguggcggccgagauggaggaggcccugcggggccugcccauccgcuaccagaccaccgccaucaagaccgagcacacggggcgggagaucgucgaccucaugugccacgccaccuucaccaugcgccugcugagccccgugcgggugcccaacuacaaccucaucaucauggacgaggcgcacuucaccgacccggccuccaucgccgcccgcggcuacaucagcacgcgggucgagaugggcgaggccgcggggaucuucaugaccgccacgccgcccggcucccgcgaccccuucccgcagagcaacgcccccaucauggacgaggagcgggagauccccgagcgcuccuggaacagcgggcacgagugggugaccgacuucaagggcaagacggugugguucguccccuccaucaaggccgggaacgacaucgcggccugccugcggaagaacggcaagaaggugauccagcugagccgcaagaccuucgacuccgaguacgugaagacccgggccaacgacugggacuucgucgugaccacggacaucagcgagaugggcgccaacuucaaggccgagcgcgugaucgacccgcggcgcugcaugaagcccgucauccucaccgacggggaggagcgggugauccuggcgggccccaugcccgugacccacuccagcgccgcccagcgccgcgggcggaucggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaaggucgacgcgaucgacggcgaguaccgccugcgcggggaggcccgcaagacguucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggaccaaggagggggagcgcaagaagcugaagccccgguggcuggacgcccgcaucuacagcgacccgcucgcccugaaggaguucaaggaguucgccgcgggccggaagucccugacccucaaccugaucaccgagaugggccgccugcccacguucaugacccagaaggcccggaacgcccucgacaaccuggccgugcugcacaccgccgaggccgggggccgcgccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcggacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccgccccgccagcgccuggacgcuguacgccguggcgaccaccuucgugaccccgaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgcgaggcccagaagcgggccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgcuucuggaacaccaccaucgccgugagcauggcgaacaucuuccggggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggccgggccacgaggagcccauccccauguccacguacggguggaaccucgugcgccugcagagcggcgucgacguguucuucacgccgcccgagaagugcgacacccugcucugcgacaucggggagagcucccccaaccccaccaucgaggccggccggacccugcgcgugcugaaccucgucgagaacuggcugaacaacaacacgcaguucugcaucaaggugcugaaccccuacaugcccagcgugaucgagaagauggaggcccuccagcggaaguacggcggggcgcugguccgcaacccccugucccggaacagcacccacgagauguacuggguguccaacgccaccggcaacaucgugagcuccgucaacaugaucagccgcaugcugaucaaccgguucaccaugaagcacaagaaggccacguacgagcccgacguggaccucggguccggcacccgcaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcggcugcucaccaagcccugggacgugguccccauggugacccagauggcgaugacggacaccaccccguucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcggagcaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacacggccggcugggacacccgcaucacccuggaggaccucaagaacgaggagauggugaccaaccacaugaagggggagcacaagaagcuggcggaggccaucuucaagcugacguaccagaacaaggucgugcgggugcagcgccccaccccgcggggcaccgucauggacaucaucucccgccgcgaccagcggggcagcgggcaggucggcaccuacgggcucaacacguucaccaacauggaggcccagcugauccgccagauggagggcgagggcaucuucaaguccauccagcaccugaccgccaccgaggagaucgccgugcagaacuggcucgcgcgggucgggcgcgagcggcugagccgcauggccaucuccggcgacgacugcguggugaagcccaucgacgaccgguucgccagcgcccugacggcccucaacgacauggggaagguccgcaaggacauccagcagugggagcccucccggggcuggaacgacuggacccaggugcccuucugcagccaccacuuccacgagcuggugaugaaggacgggcgcguccugguggugccgugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccguccccucccacugggugcccaccagccggacgaccugguccauccacgccaagcacgaguggaugaccaccgaggacaugcucgcgguguggaaccgcgucuggauccaggagaaccccuggauggaggacaagacgccgguggagagcugggaggaggugcccuaccuggggaagcgggaggaccaguggugcggcucccugaucgggcucaccagccgcgccaccugggccaagaacauccagaccgccaucaaccagguccgcagccugaucggcaacgaggaguacacggacuacaugcccuccaugaagcgguuccgccgggaggaggaggaggccggcgugcugugguga

SEQ ID NO: 9228 - RNA, 9876 nt, Artificial Sequence
  derived and/or modified CDS sequence (opt1) from DENV-2__FJ744703__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggaccgacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacagccccgugaacaucgaggcggagccgcccuucggcgacuccuacaucaucaucgggguggagccgggccagcugaagcucaacugguucaagaaggggagcuccaucggccagauguucgagaccaccaugcgcggcgccaagcggauggccauccugggggacaccgccugggacuucggcagccucgggggcgucuucacguccaucgggaaggcccuccaccagguguucggcgcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccgucgugcaggcggacuccggcugcguggucagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgugacgcgccuggagaaccucauguggaagcagaucacccccgagcugaaccacaucccguccgagaacgaggucaagcugaccaucaugaccggcgacaucaaggggaucaugcaggccggcaagcggagccuccgcccccagcccacggagcugaaguacuccuggaagaccuggggcaaggcgaagaugcugagcaccgagucccacaaccagaccuuccucaucgacgggccggagacggccgagugccccaacaccaaccgggccuggaacagccuggagguggaggacuacggcuucgggguguucaccaccaacaucuggcugaagcuccgcgagaagcaggacgucuucugcgacuccaagcugaugagcgccgccaucaaggacaaccgggcggugcacgccgacaugggcuacuggaucgaguccgcccugaacgacaccuggaagauggagaaggccagcuucaucgaggugaaguccugccacuggcccaagagccacacgcucugguccaacggcguccuggagagcgagaugaucauccccaagaacuucgccgggccggugucccagcacaacuaccgccccggcuaccacacccagaccgcggggcccuggcaccugggcaagcucgagauggacuucgacuucugcgaggggaccacgguggucgugaccgaggacugcggcaaccggggccccagccugcgcaccaccacggccagcgggaagcugaucaccgaguggugcugccgguccugcacccucccgccccugcgcuaccggggcgaggacgggugcugguacggcauggagauccgcccccugaaggagaaggaggagaaccucgugaacagccuggucaccgccgggcacggccagaucgacaacuucucccugggcgugcucgggauggcccuguuccuggaggagaugcuccggacgcgcaucggcaccaagcacgcgauccugcugguggccgucagcuucgugacccucaucaccgggaacauguccuuccgggaccugggccgcgugauggucauggugggggccacgaugaccgacgacaucggcaugggcgugaccuaccuggcccuccuggccgcguucaagguccgccccaccuucgccgccgggcugcuccugcggaagcugacgagcaaggagcucaugauggccaccaucggcaucgcccugcugucccagagcaccaucccggagaccauccucgagcugacggacgcgcuggcccucgggaugauggugcugaagaucgugcgcaacauggagaaguaccagcuggccgucaccaucauggccaucuccugcgugcccaacgccgugauccuccagaacgcguggaaggucagcugcaccauccuggccgccguguccgucagcccccugcuccugaccuccagccagcagaaggccgacuggaucccccuggcgcucacgaucaagggccugaacccgaccgccaucuuccugaccacccucucccggacgagcaagaagcgcuccuggccccugaacgaggccaucauggccgugggcauggugagcauccuggccuccagccuccugaagaacgacauccccaugaccgggccccuggucgcgggcgggcuccugaccgugugcuacgugcugaccggccggagcgccgaccucgagcuggagcgcgccgccgacgucaagugggaggaccaggccgagaucuccgggagcuccccgauccugagcaucacgaucuccgaggacggcagcauguccaucaagaacgaggaggaggagcagacccucaccauccugauccggaccggccugcucgugaucagcgggguguuccccgucuccauccccaucaccgcggccgccugguaccugugggaggugaagaagcagcgcgccggcgugcugugggacguccccagcccgccgcccguggagaaggccgagcucgaggacggggcguaccggaucaagcagcgcggcauccugggguacucccagaucggcgccggcguguacaaggaggggacguuccacaccauguggcacgucacccggggcgccgugcugaugcaccgcgggaagcggaucgagccgagcugggccgacgugaagaaggaccucaucuccuacggcgggggcuggaagcuggagggcgaguggaaggagggggaggagguccaggugcuggcccucgagcccggcaagaacccccgcgcggugcagaccaagcccgggaucuucaagacgaacaccggcaccaucggggccgucagccuggacuucuccccgggcaccagcggcucccccaucguggaccggaaggggaagguggucggccuguacgggaacggcguggugacgcgcagcggcgccuacgucuccgccaucgcgcagaccgagaaguccaucgaggacaaccccgagaucgaggacgacaucuuccggaagaagcgccucaccaucauggaccugcaccccggggccggcaagaccaagcgguaccugccggccaucgugcgcgaggccaucaagcgggggcuccgcacgcugauccuggcccccacccgcguggucgcggccgagauggaggaggcccugcggggccuccccauccgcuaccagacccccgccaucaagaccgagcacacggggcgggagaucguggaccugaugugccacgccaccuucaccaugcgccugcucagcccggugcggguccccaacuacaaccugaucaucauggacgaggcgcacuucaccgaccccgccuccaucgccgcccgcggcuacaucagcacgcggguggagaugggcgaggccgcggggaucuucaugaccgccacgccgcccggcucccgcgaccccuucccccagagcaacgcccccaucauggacgaggagcgggagauccccgagcgcuccuggaacagcgggcacgagugggugaccgacuucaagggcaagacggucugguucgugcccuccaucaaggccgggaacgacaucgcggccugccugcggaagaacggcaagaaggugauccagcucagccgcaagaccuucgacuccgaguacgucaagacccgggccaacgacugggacuucguggugaccacggacaucagcgagaugggcgccaacuucaaggccgagcgcgucaucgacccccggcgcugcaugaagcccgugauccugaccgacggggaggagcgggugauccuggcgggcccgaugcccgucacccacuccagcgccgcccagcgccgggggcgcaucggccgcaaccccaagaacgagaacgaccaguacaucuacaugggggagccccucgagaacgacgaggacugcgcccacuggaaggaggccaagaugcugcuggacaacaucaacaccccggagggcaucauccccuccauguucgagcccgagcgggagaagguggacgcgaucgacggcgaguaccgccuccgcggggaggcccgcaagacguucguggaccugaugcggcgcggcgaccugccggucuggcucgccuacaagguggccgccgaggggaucaacuacgcggaccggaaguggugcuucgacggcaucaagaacaaccagauccuggaggagaacauggagguggagaucuggaccaaggagggggagcgcaagaagcugaagccccgguggcucgacgcccgcaucuacagcgacccccuggcccugaaggaguucaaggaguucgccgcgggccggaagucccucacccugaaccugaucaccgagaugggccgccuccccacguucaugacccagaaggcccggaacgcccuggacaaccuggccguccuccacaccgccgaggccgggggccgcgccuacaaccacgcccugagcgagcugccggagacccucgagacgcugcugcuccugacccugcucgccaccgugaccgggggcaucuuccuguuccugauguccggcaaggggaucggcaagaugacccucgggaugugcugcaucaucacggccagcauccugcugugguacgcgcagauccagccccacuggaucgccgccuccaucauccucgaguucuuccugaucguccugcucauccccgagcccgagaagcagcggaccccgcaggacaaccagcugaccuacguggugaucgccauccugaccgucguggccgcgacgauggccaacgagaugggcuuccucgagaagaccaagaaggaccuggggcugggcagcaucaccacccaggagagcgaguccaacauccucgacaucgaccugcgccccgccagcgccuggacgcuguacgccguggcgaccaccuucgucacccccaugcuccggcacuccaucgagaacagcuccgugaacgugagccugacggccaucgccaaccaggccaccguccugaugggccucgggaagggcuggccccuguccaagauggacaucggggugccgcugcucgcgaucggcugcuacagccaggugaaccccaucacccugaccgccgcccugcuccugcuggucgcccacuacgccaucaucgggcccggccuccaggcgaaggccacgcgcgaggcccagaagcgggccgccgcgggcaucaugaagaaccccaccguggacgggaucaccgugaucgaccuggagccgauccccuacgaccccaaguucgagaagcagcugggccaggucaugcuccugauccugugcgugacccaggugcucaugaugcgcacgaccugggcccugugcgaggcccugacccucgccaccgggcccaucuccacgcugugggagggcaacccggggcgguucuggaacaccaccaucgccgucagcauggcgaacaucuuccgcggcuccuaccuggccggcgccgggcuccuguucagcaucaugaagaacaccacguccacccgccggggcaccgggaacaucggcgagacccugggcgagaaguggaagucccgccucaacgcccuggggaaguccgaguuccagaucuacaagaaguccggcauccaggagguggaccggacgcuggcgaaggaggggaucaagcgcggcgagaccgaccaccacgccgugucccgggggagcgccaagcuccgcugguucgucgagcggaacauggugacccccgagggcaagguggucgaccugggcugcgggcgcggcgggugguccuacuacugcggcgggcugaagaacgugcgggaggugaagggccucaccaagggcgggcccggccacgaggagcccaucccgaugagcacguacggguggaaccugguccgccugcagagcggcguggacguguucuucacgccgcccgagaagugcgacacccuccugugcgacaucggggaguccagccccaacccgaccaucgaggccggccggacccugcgcguccucaaccugguggagaacuggcugaacaacaacacgcaguucugcaucaaggugcucaaccccuacaugcccuccgucaucgagaagauggaggcccugcagcggcaguacggcggggcgcuggugcgcaacccgcucagccggaacuccacccacgagauguacugggugagcaacgccaccggcaacaucgucuccagcgugaacaugaucucccgcaugcugaucaaccgguucaccaugaagcacaagaaggccacguacgagcccgacguggaccuggggagcggcacccgcaacaucgggaucgaguccgagauccccaaccuggacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccuccugaccaagccgugggacgucgugcccauggugacccagauggcgaugaccgacacgacccccuucgggcagcagcgcgucuucaaggagaagguggacacccggacccaggagcccaaggagggcacgaagaagcugaugaagaucaccgccgaguggcucuggaaggagcugggcaagaagaagaccccgcgcaugugcacccgggaggaguucacgaagaaggugcgcuccaacgccgcccugggggccaucuucaccgacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggccgcgccaagggcucccgggccaucugguacauguggcugggggcgcgcuuccuggaguucgaggcccucggcuuccugaacgaggaccacugguucagccgggggaacagccuguccggcgucgagggggagggccuccaccgccugggcuacauccugcgggacguggggaagaaggagggcggggccauguacgccgacgacaccgccggcugggacacgcgcaucacccucgaggaccugaagaacgaggagauggucaccaaccacaugaagggggagcacaagaagcuggcggaggccaucuucaagcucaccuaccagaacaagguggugcggguccagcgccccacgccccggggcaccgugauggacaucaucagccgccgggaccagcgcggcuccgggcaggucggcaccuacgggcugaacaccuucacgaacauggaggcccagcugauccgccagauggagggcgagggcaucuucaagagcauccagcaccucaccgccaccgaggagaucgccguccagaacuggcuggcgcggguggggcgcgagcggcugucccgcauggccaucagcggcgacgacugcguggucaagcccaucgacgaccgguucgccuccgcccucaccgcccugaacgacauggggaaggugcgcaaggacauccagcagugggagccgagccggggcuggaacgacuggacccaggugcccuucugcucccaccacuuccacgagcuggucaugaaggacgggcgcgugcucgugguccccugccggaaccaggacgagcugaucggccgcgcgcggaucagccagggcgccggguggucccugaaggagaccgccugccucggcaagagcuacgcccagauguggacccugauguacuuccaccgccgggaccugcgccucgccgcgaacgccaucugcuccgccgugcccagccacugggugccgaccucccggaccacguggagcauccacgccaagcacgaguggaugaccaccgaggacaugcuggcggucuggaaccgcguguggauccaggagaaccccuggauggaggacaagacccccguggaguccugggaggagguccccuaccuggggaagcgggaggaccaguggugcggcagccucaucgggcugacgagccgcgccaccugggccaagaacauccagaccgccaucaaccaggugcggucccugaucggcaacgaggaguacaccgacuacaugccgagcaugaagcgcuuccgccgggaggaggaggaggccggcgugcucugguga

SEQ ID NO: 9229 - RNA, 9876 nt, Artificial Sequence
  derived and/or modified CDS sequence (opt1) from DENV-2__FJ850067__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccacccuggugaccccgaugcuccgccacuccaucgagaacagcuccgucaacgugagccugacggccaucgccaaccaggccaccgugcugaugggccucgggaagggcuggccccuguccaagauggacaucggggucccccugcucgcgaucggcugcuacagccaggugaaccccaucacccugaccgccgcccugcuccugcugguggcccacuacgccaucaucgggccgggccuccaggcgaaggccacgcgggaggcccagaagcgcgccgccgcgggcaucaugaagaaccccaccgucgacgggaucaccgugaucgaccuggagcccauccccuacgacccgaaguucgagaagcagcugggccaggugaugcuccugauccugugcgucacccaggugcucaugaugcggacgaccugggcccugugcgaggcccugacccucgccaccgggcccaucuccacgcugugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaccaucggcgagacgcugggcgagaaguggaagucccggcucaacgcccugggcaagagcgaguuccagaucuacaagaaguccggcauccaggaggucgaccgcacccuggcgaaggaggggaucaagcggggcgagaccgaccaccacgccgugagccgcggguccgccaagcuccggugguucguggagcgcaacauggucacccccgagggcaaggugguggaccugggcugcgggcggggcggguggagcuacuacugcggcgggcugaagaacguccgcgaggugaagggccucacgaagggcgggccgggccacgaggagcccauccccauguccaccuacggguggaaccuggugcggcugcagagcggcgucgacguguucuucacgccgcccgagaagugcgagacccuccugugcgacaucggggagagcucccccaaccccaccaucgaggccggccgcacgcugcgggugcucaaccuggucgagaacuggcugaacaacaacacccaguucugcaucaaggugcucaaccccuacaugcccagcgugaucgagaagauggaggcccugcagcgcaaguacggcggggcgcugguccggaacccccugucccgcaacagcacccacgagauguacuggguguccaacgccaccggcaacaucgugagcuccgucaacaugaucagccggaugcucaucaaccgcuucacgaugaagcacaagaaggccaccuacgagcccgacguggaccugggguccggcacccggaacaucgggaucgagagcgagaucccgaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgucgugcgccuccugaccaagcccugggacgugguccccauggugacgcagauggcgaugaccgacaccaccccguucgggcagcagcggguguucaaggagaaggucgacacgcgcacccaggagcccaaggagggcaccaagaagcugaugaagaucaccgccgaguggcucuggaaggagcugggcaagaagaagacgccccggaugugcacccgcgaggaguucacccggaaggugcgcagcaacgccgcccugggggccaucuucaccgacgagaacaaguggaaguccgcgcgggaggccguggaggacggccgcuucugggagcucgucgaccgggagcgcaaccugcaccuggaggggaagugcgagacgugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcguggagggggagggccuccaccggcugggcuacauccugcgcgacgucgggaagaaggagggcggggccauguacgccgacgacaccgccggcugggacacccggaucacccucgaggaccugaagaacgaggagauggugacgaaccacaugaagggggagcacaagaagcuggcggaggccaucuucaagcucaccuaccagaacaaggucgugcgcgugcagcggcccaccccgcgcggcaccgucauggacaucaucucccggcgcgaccagcgcggcagcgggcaggucggcacguacgggcugaacaccuucaccaacauggaggcccagcugauccggcagauggagggcgagggcaucuucaaguccauccagcaccucaccgccacggaggagaucgccgugcagaacuggcuggcgcgcgucgggcgggagcgccugagccggauggccaucuccggcgacgacugcguggugaagcccaucgacgaccgcuucgccagcgcccucaccgcccugaacgacauggggaagauccggaaggacauccagcagugggagcccucccgcggcuggaacgacuggacccagguccccuucugcagccaccacuuccacgagcuggugaugaaggacgggcgggugcucgucgugccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccgugcccucccacuggguccccacgagccgcaccaccugguccauccacgccaagcacgaguggaugaccacggaggacaugcuggcgguguggaaccggguguggauccaggagaaccccuggauggaggacaagaccccggucgagagcugggaggaggugcccuaccuggggaagcgcgaggaccaguggugcggcucccucaucgggcugaccagccgggccaccugggccaagaacauccagacggccaucaaccaggugcgcagccugaucggcaacgaggaguacaccgacuacaugcccuccaugaagcgcuuccggcgcgaggaggaggaggccggcguccucugguga

SEQ ID NO: 9230 - RNA, 9876 nt, Artificial Sequence
  derived and/or modified CDS sequence (opt1) from DENV-2__FJ850060__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaagauccgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucguccgcaacauggagaaguaccagcuggccgugacgaucauggccaucuccugcgugccgaacgccgucauccugcagaacgcguggaaggugagcugcgccauccucgccgccguguccgucagcccccugcugcucaccuccagccagcagaaggcggacuggaucccccuggcccugaccaucaagggccucaaccccaccgccaucuuccugacgacccugucccggaccagcaagaagcgcuccuggccgcucaacgaggccgugauggccgucggcauggugagcauccuggcguccagccugcucaagaacgacauccccaugaccgggccccugguggccggcgggcugcucacggucugcuacgugcugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacccugacgauccucauccggaccggccugcuggucaucagcgggguguucccgguguccauccccaucaccgccgccgccugguaccucugggaggucaagaagcagcgcgccggcgugcugugggacgugcccagcccgccgcccgucgagaaggcggagcuggaggacggggccuaccggaucaagcagcgcggcauccucggguacucccagaucggcgccggcguguacaaggaggggaccuuccacaccauguggcacgugacgcggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccgggaucuucaagaccaacaccggcacgaucggggccgugagccucgacuucucccccggcaccagcggcucccccaucgucgaccggaaggggaagguggugggccuguacgggaacggcgucgugacccgcagcggcgccuacguguccgcgaucgcccagaccgagaaguccaucgaggacaaccccgagaucgaggacgacaucuuccggaagaagcgccugacgaucauggaccuccaccccggggccggcaagaccaagcgguaccugcccgccaucguccgcgaggccaucaagcgggggcugcgcacccugauccucgcgccgacccgcgugguggccgccgagauggaggaggcccugcggggccugcccauccgcuaccagacgcccgccaucaagaccgagcacaccgggcgggagaucgucgaccucaugugccacgcgaccuucacgaugcgccugcugagccccgugcgggugccgaacuacaaccucaucaucauggacgaggcccacuucaccgaccccgccuccaucgccgcccgcggcuacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagaccuucgacuccgaguacgugaagacgcgggccaacgacugggacuucgucgugaccaccgacaucagcgagaugggcgccaacuucaaggcggagcgcgugaucgacccccggcgcugcaugaagcccgucauccucaccgacggggaggagcgggugauccuggccggccccaugccggugacgcacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcauccgcaacaaccagauccucgaggagaacauggagguggagaucuggaccaaggagggggagcggaagaagcugaagccgcgcuggcuggacgcccggaucuacagcgacccccucgcccugaaggaguucaaggaguucgcggccggccgcaagucccugacgcucaaccugaucaccgagaugggcaagcugcccaccuucaugacccagaaggcccggaacgcccucgacaaccuggccgugcugcacacggcggaggccgggggccgcgccuacaaccacgcccucagcgagcugcccgagacccuggagacccuccugcugcucacccugcuggccacggucaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucacguacgucgugaucgccauccugaccguggucgcggccaccauggccaacgagaugggcuuccuggagaagaccaagaaggaccucgggcugggcagcaucacgacccaggagagcgaguccaacauccuggacaucgaccuccgcccggccagcgccuggacccuguacgcgguggccaccacguucgugacccccaugcugcggcacuccaucgagaacagcuccgucaacgugagccucaccgccaucgccaaccaggcgaccgugcugaugggccuggggaagggcuggccccucuccaagauggacaucggggucccccugcuggccaucggcugcuacagccaggugaacccgaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgagcccaucccguacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaaccccgggcgguucuggaacaccacgaucgcggugagcauggccaacaucuuccgcggcuccuaccuggccggcgccgggcuccuguucagcaucaugaagaacaccaccaacacccgccggggcacggggaacaucggcgagacccugggcgagaaguggaagucccgccugaacgcgcucggcaagagcgaguuccagaucuacaagaaguccggcauccaggaggucgaccggacccuggccaaggaggggaucaagcgcggcgagaccgaccaccacgccgugagccggggguccgccaagcugcgcugguucguggagcggaacauggucacgccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucaccccgcccgagaagugcgacacgcugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggaggcgcuccagcggaaguacggcggggcccugguccgcaacccccugucccggaacagcacccacgagauguacuggguguccaacgccacgggcaacaucgugagcuccgucaacaugaucagccgcaugcugaucaaccgguucaccaugaagcacaagaaggccaccuacgagccggacguggaccucggguccggcacccgcaacaucgggaucgagagcgagauccccaaccuggacaucaucggcaagcggaucgagaagaucaagcaggagcacgagacguccuggcacuacgaccaggaccaccccuacaagaccugggccuaccacggcagcuacgagaccaagcagaccggguccgcgagcuccauggugaacggcgucgugcgccugcucacgaagcccugggacguggucccgauggugacccagauggccaugaccgacaccacgcccuucgggcagcagcgcguguucaaggagaaggucgacacccggacccaggagcccaaggagggcaccaagaagcugaugaagaucacggccgaguggcuguggaaggagcucggcaagaagaagacgccccgcaugugcacccgggaggaguucacccgcaaggugcggagcaacgccgcccugggggcgaucuucacggacgagaacaaguggaaguccgcccgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacaccgcgggcugggacacccgcaucacgcuggaggaccucaagaacgaggagauggugaccaaccacaugaagggggagcacaagaagcuggccgaggccaucuucaagcugaccuaccagaacaaggucgugcgggugcagcgcccgacgccccggggcacggucauggacaucaucucccgccgggaccagcgcggcagcgggcaggucggcaccuacgggcucaacaccuucaccaacauggaggcccagcugauccgccagauggagggcgagggcaucuucaaguccauccagcaccugacggccaccgaggagaucgcggugcagaacuggcucgcccgggucgggcgcgagcggcugagccgcauggccaucuccggcgacgacugcguggugaagcccaucgacgaccgguucgccagcgcccugaccgcgcucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggcgccggguggagccugaaggagacggccugccugggcaaguccuacgcccagauguggacccucauguacuuccaccgccgggaccugcgccuggcggccaacgccaucugcagcgccgugccgccccacugggugccgaccucccggaccaccuggagcauccacgcgaagcacgaguggaugacgaccgaggacaugcucgccguguggaaccgcgucuggauccaggggaaccccuggauggaggacaagacccccguggaguccugggaggaggugcccuaccugggcaagcgggaggaccaguggugcgggagccugaucggccucaccucccgcgccacgugggccaagaacauccagaccgccaucaaccagguccggagccugaucggcaacgaggaguacaccgacuacaugccgagcaugaagcgcuuccgccgggaggaggaggaggcgggggugcugugguga

SEQ ID NO: 9231 - RNA, 9876 nt, Artificial Sequence
  derived and/or modified CDS sequence (opt1) from DENV-2__FJ850061__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgccacgaccaugcgcggcgccaagcggauggccauccugggggacaccgccugggacuucggcagccucggcgggguguucaccuccaucgggaaggcgcuccaccaggucuucggggccaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggcgauggugcaggccgacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgcgaucaaggacaaccgggccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgcggggcccgugucccagcacaacuaccgcccgggcuaccacacgcagaccgccgggcccuggcaccucggcaagcuggagauggacuucgaccugugcgaggggaccaccgucguggugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcaucggcacgaagcacgccauccuccuggucgccgugagcuucgugacccugaucaccgggaacauguccuuccgggaccucggccgcgucauggugauggugggggccaccaugacggacgacaucggcaugggcgucaccuaccuggcccugcucgcggccuucaaggugcgccccaccuucgccgccgggcugcugcuccggaagcugaccagcaaggagcugaugauggccacgaucggcaucgcgcuccugucccagagcaccauccccgagaccauccuggagcucaccgacgcccuggcccuggggaugauggugcucaagaucguccgcaacauggagaaguaccagcuggccgugacgaucauggccaucuccugcgugccgaacgcggucauccugcagaacgccuggaaggugagcugcaccauccucgccgccguguccgucagcccccugcugcucaccuccagccagcagaaggcggacuggaucccccuggcccugaccaucaagggccucaaccccacggccaucuuccugaccacccugucccggaccagcaagaagcgcuccuggccgcucaacgaggccaucauggccgugggcauggucagcauccuggcguccagccugcucaagaacgacauccccaugacggggccccugguggccggcgggcugcucaccgugugcuacguccugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacgcugaccauccucauccggaccggccugcuggugaucagcggggucuucccgguguccauccccaucaccgccgccgccugguaccucugggaggugaagaagcagcgcgccggcguccugugggacgugcccagcccgccgcccguggagaaggcggagcuggaggacggggccuaccggaucaagcagcgcggcauccucggguacucccagaucggcgccggcgucuacaaggaggggaccuuccacacgauguggcacgugacccggggcgccgugcugaugcaccgcgggaagcggaucgagcccagcugggccgacgucaagaaggaccugaucuccuacggcgggggcuggaagcucgagggcgaguggaaggagggggaggagguccaggugcuggcgcuggagcccggcaagaacccccgcgccguccagaccaagcccgggaucuucaagaccaacacgggcaccaucggggccgugagccucgacuucucccccggcaccagcggcucccccaucguggaccggaaggggaaggucgugggccuguacgggaacggcguggucacccgcagcggcgccuacguguccgcgaucgcccagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgcgccgacgcgcgucguggccgccgagauggaggaggcccugcggggccugcccauccgcuaccagacccccgccaucaagaccgagcacaccgggcgggagaucguggaccucaugugccacgcgacguucaccaugcgccugcugagccccguccgggugccgaacuacaaccucaucaucauggacgaggcccacuucaccgaccccgccuccaucgccgcccgcggcuacaucagcacccggguggagaugggcgaggcggccgggaucuucaugacggccacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggcggggaacgacaucgccgccugccugcggaagaacggcaagaaggucauccagcugagccgcaagacguucgacuccgaguacgugaagacccgggccaacgacugggacuucguggucaccaccgacaucagcgagaugggcgccaacuucaaggcggagcgcgugaucgacccccggcgcugcaugaagcccgugauccucacggacggggaggagcgggucauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaagguggacgccaucgacggcgaguaccgccugcgcggggaggcccgcaagaccuucgucgaccucaugcggcgcggcgaccugcccguguggcuggccuacaagguggccgcggaggggaucaacuacgccgaccggaaguggugcuucgacggcaucaagaacaaccagauccucgaggagaacauggaggucgagaucuggacgaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccaccuucaugacgcagaaggcccggaacgcccucgacaaccuggccgugcugcacaccgcggaggccgggggccgcgccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucaccuacguggucaucgccauccugaccgugguggcggccaccauggccaacgagaugggcuuccuggagaagacgaagaaggaccucgggcugggcagcaucaccacccaggagagcgaguccaacauccuggacaucgaccuccgcccggccagcgccuggacccuguacgcggucgccacgaccuucgugacccccaugcugcggcacuccaucgagaacagcuccgugaacgucagccucaccgccaucgccaaccaggcgacggugcugaugggccuggggaagggcuggccccucuccaagauggacaucggggugccccugcuggccaucggcugcuacagccaggucaagccgaucaccuucaccgccgcccuccugcugcucguggcccacuacgcgaucaucgggcccggccugcaggccaaggcgccccgcgaggcccagaagcgggccgcggccggcaucaugaagaaccccaccguggacgggaucacggucaucgaccuggagccgauccccuacgaccccaaguucgagaagcagcucggccaggugaugcugcugauccucugcgugacccagguccugaugaugcgcaccaccugggcccugugcgaggcccucacgcuggccaccgggcccaucuccacccugugggagggcaacccggggcgguucuggaacaccacgaucgcggugagcauggccaacaucuuccgcggcuccuaccucgccggcgccgggcugcuguucagcaucaugaagaacaccaccaacacccgccggggcacggggaacaucggcgagacccucggcgagaaguggaagucccgccugaacgcgcugggcaagagcgaguuccagaucuacaagaaguccggcauccaggagguggaccggacccucgccaaggaggggaucaagcgcggcgagaccgaccaccacgccgucagccggggguccgccaagcugcgcugguucguggagcggaacauggugacgcccgagggcaaggucguggaccugggcugcgggcgcggcggguggagcuacuacugcggcgggcucaagaacgugcgggaggucaagggccugaccaagggcgggcccggccacgaggagcccaucccgauguccaccuacggguggaaccuggugcgccuccagagcggcguggacgucuucuucacgccgcccgagaagugcgacacgcugcugugcgacaucggggagagcucccccaacccgaccaucgaggccggccggacccuccgcgugcugaaccugguggagaacuggcucaacaacaacacccaguucugcaucaagguccugaaccccuacaugcccagcgugaucgagaagauggaggcgcugcagcggaaguacggcggggcccucgugcgcaacccgcugucccggaacagcacccacgagauguacugggucuccaacgccacgggcaacaucgugagcuccgugaacaugaucagccgcaugcugaucaaccgguucaccaugaagcacaagaaggccaccuacgagcccgacgucgaccugggguccggcacccgcaacaucgggaucgagagcgaggugcccaaccucgacaucaucggcaagcggaucgagaagaucaagcaggagcacgagacguccuggcacuacgaccaggaccaccccuacaagaccugggccuaccacggcagcuacgagaccaagcagaccggguccgcgagcuccauggugaacggcgucgugcgccugcugacgaagccgugggacgugguccccauggugacccagauggccaugaccgacaccacgcccuucgggcagcagcgcguguucaaggagaaggucgacacccggacccaggagcccaaggagggcaccaagaagcucaugaagaucacggccgaguggcuguggaaggagcugggcaagaagaagaccccgcgcaugugcacccgggaggaguucacccgcaaggugcggagcaacgccgcccucggggcgaucuucacggacgagaacaaguggaaguccgcccgcgaggccguggaggacggccgguucugggagcuggucgaccgcgagcggaaccugcaccucgaggggaagugcgagaccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccgggggaacagccucagcggcguggagggggagggccugcaccgccugggcuacauccuccgggacgucgggaagaaggagggcggggccauguacgccgacgacaccgcgggcugggacacccgcaucacgcuggaggaccugaagaacgaggagauggugaccaaccacaugaagggggagcacaagaagcucgccgaggccaucuucaagcugaccuaccagaacaaggucgugcgggugcagcgccccacgccccggggcacggucauggacaucaucucccgccgggaccagcgcggcagcggccaggugggcaccuacgggcugaacaccuucaccaacauggaggcccagcucauccgccagauggagggcgagggcaucuucaaguccauccagcaccugacggccaccgaggagaucgcggugcagaacuggcuggcccgggucgggcgcgagcggcucagccgcauggccaucuccggcgacgacugcguggugaagcccaucgacgaccgguucgccagcgcccugaccgcgcugaacgacauggggaagguccgcaaggacauccagcagugggagccgucccggggcuggaacgacuggacccaggugcccuucugcagccaccacuuccacgagcucgugaugaaggacgggcgcguccugguggugcccugccggaaccaggacgagcugaucggccgcgcccggaucucccagggcgccggguggagccucaaggagacggccugccugggcaaguccuacgcccagauguggacccugauguacuuccaccgccgggaccuccgccuggcggccaacgccaucugcagcgccgugccgccccacugggugcccaccucccggaccaccuggagcauccacgcgaagcacgaguggaugacgaccgaggacaugcuggccguguggaaccgcgucuggauccaggagaaccccuggauggaggacaagacccccguggaguccugggaggaggugcccuaccucgggaagcgggaggaccaguggugcggcagccugaucgggcugaccucccgcgccacgugggccaagaacauccagaccgccaucaaccagguccggagccucaucggcaacgaggaguacaccgacuacaugcccagcaugaagcgcuuccgccgggaggaggaggaggcgggcgugcugugguga

SEQ ID NO: 9232 - RNA, 9876 nt, Artificial Sequence
  derived and/or modified CDS sequence (opt1) from DENV-2__FJ744709__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcggugcuggccuacaccaucgggaccacgcacuuccagaaggcccucaucuucauccugcugaccgccgucgcgcccagcaugaccaugcggugcaucggcaucagcaaccgcgacuucguggagggcgugagcgggggcagcugggucgacaucgugcucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccauggucgaccgcggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccgccagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgucauccgggugcaguacgagggcgacggcucccccugcaagauccccuucgagaucaccgaccuggagaagcgccacgugcucgggcggcugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagacgaccaugcgcggcgccaagcgcauggccauccugggggacaccgccugggacuucggcagccucggcgggguguucaccuccaucgggaaggcccuccaccagguguucggggcgaucuacggcgccgccuucagcggggucuccuggacgaugaagauccugaucggcgugaucaucaccuggaucgggaugaacagccgguccaccagccuguccgugagccugguccucgugggcguggucacccuguaccugggggccguggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccgcagcgucacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacccggaucggcacgaagcacgcgauccugcucgucgccgugagcuucgugacccugaucaccgggaacauguccuuccgcgaccugggccgggucauggugauggugggggccaccaugacggacgacaucggcaugggcgucaccuaccucgcccugcuggccgcguucaaggugcgccccaccuucgccgccgggcuccugcugcgcaagcucaccagcaaggagcugaugauggccacgaucggcaucgcccugcucucccagagcaccauccccgagaccauccuggagcugaccgacgcgcucgcccuggggaugauggugcugaagaucguccggaacauggagaaguaccagcucgccgugacgaucauggccaucuccugcgugccgaacgccgucauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccgugggcauggucagcauccucgccuccagccugcugaagaacgacauccccaugacggggccccucguggcgggcgggcugcugaccgugugcuacguccucaccggccgcagcgccgaccuggagcuggagcgggccgccgacgugaagugggaggaccaggccgagaucuccgggagcucccccauccucagcaucaccaucuccgaggacggcagcauguccaucaagaacgaggaggaggagcagacgcugaccauccugauccgcaccggccuccuggugaucagcgggaucuucccggucuccauccccaucaccgcggccgccugguaccugugggaggugaagaagcagcgggccggcgugcucugggacguccccagcccgccgcccguggagaaggccgagcuggaggacggggcguaccgcaucaagcagcggggcauccugggguacucccagaucggcgccggcguguacaaggaggggaccuuccacacgauguggcacgucacccgcggcgccgugcucaugcaccgggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggaucuucaagaccaacacgggcaccaucggggccgucagccuggacuucucccccggcaccagcggcucccccaucguggaccgcaaggggaagguggucggccucuacgggaacggcguggugacccggagcggcgccuacgucuccgccaucgcgcagacggagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcggacccugauccuggccccgacgcgcguggucgcggccgagauggaggaggcccuccgcggccugcccauccgguaccagacccccgccaucaagaccgagcacaccgggcgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccuccgcaagaacggcaagaaggugauccagcugagccggaagacguucgacuccgaguacgucaagacccgcgccaacgacugggacuucguggugaccaccgacaucagcgagaugggcgccaacuucaaggccgagcgggucaucgacccccgccggugcaugaagcccgugauccugacggacggggaggagcgcgugauccucgcgggccccaugccggucacccacuccagcgccgcccagcggcgcgggcggaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgcgagaagguggacgcgaucgacggcgaguaccggcugcgcggggaggcccggaagaccuucguggaccugaugcgccggggcgaccuccccgucuggcuggccuacaagguggccgccgaggggaucaacuacacggaccgcaaguggugcuucgacggcaucaagaacaaccagauccuggaggagaacauggagguggagaucuggaccaaggagggggagcggaagaagcucaagccgcgcuggcuggacgcgcggaucuacagcgacccccuggcccucaaggaguucaaggaguucgccgccggccgcaagucccugacccugaaccucaucaccgagaugggccggcugcccacguucaugacccagaaggcgcgcaacgcccuggacaaccucgccguccugcacaccgccgaggccgggggccgggcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcgcacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcggccggccagcgccuggacgcucuacgccguggccaccaccuucgucacccccaugcugcgccacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgggaggcccagaagcgcgccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcggacgaccugggcgcugugcgaggcccucacccuggccaccgggcccaucuccacgcugugggagggcaaccccgggcgcuucuggaacaccaccaucgccgucagcauggccaacaucuuccggggcuccuaccucgcgggcgccgggcugcuguucagcaucaugaagaacaccacguccacccgccgcggcaccgggaacaucggcgagacccucggcgagaaguggaagucccggcugaacgcccuggggaaguccgaguuccagaucuacaagaaguccggcauccaggagguggaccgcacgcucgccaaggaggggaucaagcggggcgagaccgaccaccacgcggugucccgcgggagcgccaagcugcggugguucgucgagcgcaacauggugaccccggagggcaagguggucgaccugggcugcgggcggggcgggugguccuacuacugcggcgggcucaagaacgugcgcgaggugaagggccugaccaagggcgggcccggccacgaggagcccauccccaugagcacguacggguggaaccugguccggcuccagagcggcguggacguguucuucaccccgcccgagaagugcgacacccugcugugcgacaucggggaguccagccccaaccccaccaucgaggccggccgcacccuccggguccugaaccugguggagaacuggcucaacaacaacacgcaguucugcaucaaggugcugaacccguacaugcccuccgucaucgagaagauggaggcccugcagcgccaguacggcggggcccucgugcggaacccccugagccgcaacuccacccacgagauguacugggugagcaacgcgaccggcaacaucgucuccagcgugaacaugaucucccggaugcugaucaaccgcuucaccaugaagcacaagaaggccacguacgagccggacguggaccuggggagcggcacccggaacaucgggaucgaguccgagauccccaaccucgacaucaucggcaagcgcaucgagaagaucaagcaggagcacgagaucagcuggcacuacgaccaggaccaccccuacaagaccugggccuaccacggcuccuacgagaccaagcagacggggagcgccuccagcauggucaacggcguggugcggcugcugaccaagcccugggacgucgugccgauggugacccagauggccaugaccgacacgacccccuucgggcagcagcgcgucuucaaggagaagguggacacccgcacccaggagcccaaggagggcacgaagaagcucaugaagaucaccgcggaguggcuguggaaggagcugggccggaagaagacgccccgcaugugcacccgggaggaguucacgcgcaaggugcgguccaacgccgcccucggggccaucuucaccgacgagaacaaguggaaguccgcccgcgaggcggucgaggacggccgguucugggagcugguggaccgcgagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacagccucuccggggucgagggcgaggggcugcaccgccugggcuacauccuccgggacgugggcaagaaggagggcggcgccauguacgccgacgacaccgccgggugggacacgcgcaucacccuggaggaccugaagaacgaggagauggucaccaaccacaugaagggcgagcacaagaagcucgccgaggcgaucuucaagcugaccuaccagaacaagguggugcggguccagcgcccgacgccccgggggaccgugauggacaucaucagccgccgggaccagcgcggcuccggccagguggggaccuacggccugaacaccuucacgaacauggaggcccagcucauccgccagauggagggggagggcaucuucaagagcauccagcaccugaccgccaccgaggagaucgccguccagaacuggcuggcccgggugggccgcgagcggcucucccgcauggcgaucagcggggacgacugcguggucaagcccaucgacgaccgguucgccuccgcccugaccgcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucgggcgcgcccggaucagccagggcgcgggcuggucccucaaggagaccgccugccugggcaagagcuacgcccagauguggacccugauguacuuccaccgccgggaccuccgccuggccgccaacgcgaucugcuccgccgugcccagccacugggugcccaccucccggaccacguggagcauccacgccaagcacgaguggaugaccaccgaggacaugcuggccgucuggaaccgcguguggauccaggagaacccguggauggaggacaagacccccguggaguccugggaggagguccccuaccucggcaagcgggaggaccaguggugcgggagccugaucggccugacgagccgcgcgaccugggccaagaacauccagaccgccaucaaccaggugcggucccucaucgggaacgaggaguacaccgacuacaugcccagcaugaagcgcuuccgccgggaggaggaggaggccggcgugcugugguga

SEQ ID NO: 9233 - RNA, 9876 nt, Artificial Sequence
  derived and/or modified CDS sequence (opt1) from DENV-2__FJ744708__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcggagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggugaacaucuucuccggcagcuaccucgcgggcgccgggcugcacgugccgcugcgcaagaacacccuccgcacccggcgcggcacggggaacaccggcgagacccugggcgagaaguggaagucccggcugaacgcccucggcaagagcgaguuccagaucuacaagaaguccggcauccaggaggucgaccgcacccuggccaaggaggggaucaagcggggcgagacggaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucacgccgcccgagaagugcgacacccugcucugcgacaucggggagagcucccccaacccgaccaucgaggccggccgcacccugcgggugcugaaccucgucgagaacuggcugaacaacaacacccaguucugcaucaaggugcugaaccccuacaugcccagcgugaucgagaagauggaggcccuccagcgccaguacggcggggcccugguccggaacccgcugucccgcaacagcacgcacgagauguacuggguguccaacgcgaccggcaacaucgugagcuccgucaacaugaucagccggaugcugaucaaccgcuucaccaugaagcacaagaaggccaccuacgagcccgacguggaccucggguccggcacgcggaacaucgggaucgagagcgagauccccaaccuggacaucaucggcaagcgcaucgagaagaucaagcaggagcacgagaucuccuggcacuacgaccaggaccaccccuacaagaccugggccuaccacggcagcuacgagaccaagcagaccggguccgccagcuccauggugaacggcgucgugcgccugcucacgaagccgugggacgugguccccauggugacccagauggccaugaccgacaccacgcccuucgggcagcagcggguguucaaggagaaggucgacacccgcacccaggagcccaaggagggcaccaagaagcugaugaagaucacggcggaguggcuguggaaggagcucggcaagaagaagaccccgcggaugugcacccgcgaggaguucaccaagaaggugcggagcaacgccgcccugggggccaucuucacggacgagaacaaguggaaguccgcccgcgaggcgguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggggaacagccugagcggcgucgagggggagggccugcaccgccucggcuacauccugcgggacguggggaagaaggagggcggggccauguacgccgacgacaccgccggcugggacacccgcaucacgcuggaggaccucaagaacgaggagauggugaccaaccacaugaagggggagcacaagaagcuggccgaggcgaucuucaagcugaccuaccagaacaaggucgugcgggugcagcgccccacgccccggggcacggucauggacaucaucucccgccgggaccagcgcggcagcgggcaggucggcaccuacgggcucaacaccuucaccaacauggaggcccagcugauccgccagauggagggcgagggcaucuucaaguccauccagcaccugacggccaccgaggagaucgccgugcagaacuggcucgcccgggucgggcgcgagcggcugagccgcauggcgaucuccggcgacgacugcguggugaagcccaucgacgaccgguucgccagcgcccugaccgcccucaacgacauggggaagguccgcaaggacauccagcagugggagccgucccggggcuggaacgacuggacccaggugcccuucugcagccaccacuuccacgagcuggugaugaaggacgggcgcguccugguggugcccugccggaaccaggacgagcucaucggccgcgcccggaucucccagggcgcgggguggagccugaaggagacggccugccugggcaaguccuacgcccagauguggacccucauguacuuccaccgccgggaccugcgccuggccgccaacgcgaucugcagcgccguccccucccacugggugccgaccagccggaccaccugguccauccacgccaagcacgaguggaugacgaccgaggacaugcucgccguguggaaccgcgucuggauccaggagaaccccuggauggaggacaagacccccguggagagcugggaggaggugcccuaccuggggaagcgggaggaccaguggugcggcucccugaucgggcucaccagccgcgcgacgugggccaagaacauccagaccgccaucaaccagguccggagccugaucggcaacgaggaguacaccgacuacaugccguccaugaagcgcuuccgccgggaggaggaggaggccggcgugcugugguga

SEQ ID NO: 9234 - RNA, 9876 nt, Artificial Sequence
  derived and/or modified CDS sequence (opt1) from DENV-2__FJ810418__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucaagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccguggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagauggugauccccaagaacuucgccgggcccgucucccagcacaacuaccgcccgggcuaccacacgcagaccgcggggcccuggcaccucggcaagcuggagauggacuucgacuucugcgaggggaccaccgugguggucacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcaucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugaugguccugaagaucgugcgcaacauggagaaguaccagcucgccgugacgaucauggccaucuccugcgucccgaacgccgugauccugcagaacgcguggaaggucagcugcaccauccuggccgccguguccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgucggcauggugagcauccucgccuccagccugcugaagaacgacauccccaugacggggccccucguggcgggcgggcugcugaccgucugcuacgugcucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggucaucagcgggguguucccgguguccauccccaucaccgcggccgccugguaccugugggaggucaagaagcagcgcgccggcgugcucugggacgugcccagcccgccgcccgucgagaaggccgagcuggaggacggggcguaccggaucaagcagcgcggcauccugggguacucccagaucggcgccggcguguacaaggaggggaccuuccacacgauguggcacgugacccggggcgccguccucaugcaccgcgggaagcggaucgagcccagcugggccgacgugaagaaggaccugaucuccuacggcgggggcuggaagcuggagggcgaguggaaggagggggaggaggugcagguccucgcccuggagcccggcaagaacccccgcgcggugcagaccaagcccgggaucuucaagaccaacacgggcaccaucggggccgugagccuggacuucucccccggcaccagcggcucccccaucgucgaccggaaggggaagguggugggccucuacgggaacggcgucgugacccgcagcggcgccuacguguccgccaucgcgcagacggagaaguccaucgaggacaaccccgagaucgaggacgacaucuuccggaagaagcgccugaccaucauggaccugcaccccggggccggcaagaccaagcgguaccuccccgccaucguccgcgaggccaucaagcgggggcugcgcacccugauccuggccccgacgcgcgugguggcggccgagauggaggaggcccuccggggccugcccauccgcuaccagacccccgccaucaagaccgagcacaccgggcgggagaucgucgaccugaugugccacgccacguucaccaugcgccuccugagccccgugcgggugccgaacuacaaccugaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccuccggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccugacggacggggaggagcgggugauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaaggucgacgcgaucgacggcgaguaccgccugcgcggggaggcccgcaagaccuucguggaccugaugcggcgcggcgaccuccccguguggcuggccuacaaggucgccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcggacgccccaggacaaccagcugaccuacgucgugaucgccauccucaccguggucgccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgugacccccaugcugcggcacuccaucgagaacagcuccgucaacgugagccugaccgccaucgccaaccaggccacggugcucaugggccuggggaagggcuggccccuguccaagauggacaucggggucccccuccuggcgaucggcugcuacagccaggugaacccgaucacccugaccgccgcccuccugcugcucguggcccacuacgccaucaucgggcccggccugcaggcgaaggccacccgcgaggcccagaagcgggccgccgcgggcaucaugaagaaccccacggucgacgggaucaccgugaucgaccuggagcccaucccguacgaccccaaguucgagaagcagcucggccaggugaugcugcugauccucugcgucacccaggugcugaugaugcgcaccacgugggcccugugcgaggcccucacccuggccaccgggcccaucuccacccugugggagggcaaccccgggcgguucuggaacacgaccaucgccgugagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggaggucgaccggacccucgcgaaggaggggaucaagcgcggcgagacggaccaccacgccgugucccgggggagcgccaagcugcgcugguucguggagcggaacauggucaccccggagggcaaggugguggaccugggcugcgggcgcggcgggugguccuacuacugcggcgggcucaagaacguccgggaggugaagggccugaccaagggcgggcccggccacgaggagcccauccccaugagcaccuacggguggaaccuggugcgccuccagagcggcgucgacguguucuucacgccgcccgagaagugcgacacccugcugugcgacaucggggaguccagccccaaccccaccaucgaggccggccggacccuccgcgugcugaaccuggucgagaacuggcucaacaacaacacccaguucugcaucaaggugcugaacccguacaugcccuccgugaucgagaagauggaggcccugcagcggcaguacggcggggcgcucguccgcaacccccugagccggaacuccacgcacgagauguacugggugagcaacgccaccggcaacaucguguccagcgucaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggugaacggcgucgugcgccugcugacgaagcccugggacguggucccgauggugacccagauggcgaugaccgacaccacgcccuucgggcagcagcgcguguucaaggagaaggucgacacccggacccaggagcccaaggagggcaccaagaagcucaugaagaucacggccgaguggcuguggaaggagcugggcaagaagaagacgccccgcaugugcacccggguggaguucaccaagaaggugcgcuccaacgccgcccucggggccaucuucacggacgagaacaaguggaaguccgcgcgggaggccgucgaggacggccgcuucugggagcugguggaccgggagcgcaaccugcaccucgaggggaagugcgagaccugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggccgacgccccgcggcacggugauggacaucaucagccggcgcgaccagcggggcuccgggcaggucggcaccuacgggcugaacaccuucaccaacauggaggcccagcucauccgccagauggagggcgagggcaucuucaagagcauccagcaccugacggccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9235 - RNA, 9876 nt, Artificial Sequence
  derived and/or modified CDS sequence (opt1) from DENV-2__FJ639835__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagauggugauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcaucggcacgaagcacgcgauccugcucgucgccgugagcuucgugacccugaucaccgggaacauguccuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucguccgcaacauggagaaguaccagcucgccgugacgaucauggccaucuccugcgugccgaacgccgucauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggucagcauccucgccuccagccugcugaagaacgacauccccaugacggggccccucguggcgggcgggcugcugaccgugugcuacguccucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcggggucuucccgguguccauccccaucaccgcggccgccugguaccugugggaggugaagaagcagcgcgccggcguccucugggacgugcccagcccgccgcccguggagaaggccgagcuggaggacggggcguaccggaucaagcagcgcggcauccugggguacucccagaucggcgccggcgucuacaaggaggggaccuuccacacgauguggcacgugacccggggcgccgugcucaugcaccgcgggaagcggaucgagcccagcugggccgacgucaagaaggaccugaucuccuacggcgggggcuggaagcuggagggcgaguggaaggagggggaggagguccaggugcucgcccuggagcccggcaagaacccccgcgcgguccagaccaagcccgggaucuucaagaccaacacgggcaccaucggggccgugagccuggacuucucccccggcaccagcggcucccccaucguggaccggaaggggaaggucgugggccucuacgggaacggcguggucacccgcagcggcgccuacguguccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcgucguggcggccgagauggaggaggcccuccggggccugcccauccgcuaccagacccccgccaucaagaccgagcacaccgggcgggagaucguggaccugaugugccacgccacguucaccaugcgccuccugagccccguccgggugccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgcggccugccuccggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccugacggacggggaggagcgggucauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucgucgaccugaugcggcgcggcgaccuccccguguggcuggccuacaagguggccgccgaggggaucaacuacgcggaccggaaguggugcuucgacggcaucaagaacaaccagauccuggaggagaacauggaggucgagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccgugcugcacaccgccgaggccggcgggcgcgccuacaaccacgcccugagcgagcuccccgagacccuggagacccugcuccugcugacgcuccuggccaccgucaccggcgggaucuuccuguuccucauguccggcaagagcaucgggaagaugacccuggggaugugcugcaucaucaccgccuccauccugcucuggcacgcgcagauccagccgcacuggaucgccgccagcaucauccuggaguucuuccugaucgugcuccugauccccgagcccgagaagcagcggacgccccaggacaaccagcugaccuacguggucaucgccauccucaccgugguggccgcgaccauggccaacgagaugggguuccuggagaagacgaagaaggaccugggccucgggagcaucaccacccaggaguccgagagcaacauccuggacaucgaccugcgcccggccuccgccuggacccucuacgccgucgcgacgaccuucgugacccccaugcugcggcacagcaucgagaacuccagcgugaacgucucccugaccgccaucgccaaccaggccacggugcucaugggccugggcaagggguggccccugagcaagauggacaucggcgugccccuccuggcgaucgggugcuacucccaggucaacccgaucacccugaccgccgcccuccugcugcucguggcccacuacgccaucaucggccccgggcugcaggcgaaggccacccgcgaggcccagaagcgggccgccgcgggcaucaugaagaaccccacgguggacggcaucaccgucaucgaccuggagcccaucccguacgaccccaaguucgagaagcagcucggccaggugaugcugcugauccucugcgugacccagguccugaugaugcgcaccacgugggcccugugcgaggcccucacccuggccaccggccccaucagcacccugugggaggggaaccccggccgguucuggaacacgaccaucgccguguccauggcgaacaucuuccgcgggagcuaccucgccggcgccggccugcuguucuccaucaugaagaacaccaccagcacgcgccgggggaccggcaacaucggggagacccucggcgagaaguggaagucccgccugaacgcccugggcaagagcgaguuccagaucuacaagaaguccgggauccaggagguggaccggacccucgcgaaggagggcaucaagcgcggggagacggaccaccacgccgucagccggggcuccgccaagcugcgcugguucguggagcggaacauggugaccccggaggggaaggucguggaccugggcugcggccgcgggggcuggagcuacuacugcgggggccucaagaacgugcgggaggucaaggggcugaccaagggcggccccgggcacgaggagcccauccccaugagcaccuacggcuggaaccuggugcgccuccaguccgggguggacgucuucuucacgccgcccgagaagugcgacacccugcugugcgacaucggcgagagcucccccaaccccaccaucgaggccgggcggacccuccgcgugcugaaccugguggagaacuggcucaacaacaacacccaguucugcaucaagguccugaacccguacaugcccagcgugaucgagaagauggaggcccugcagcggcaguacggcggcgcgcucgugcgcaacccccugucccggaacagcacgcacgagauguacugggucuccaacgccaccgggaacaucgugagcuccgugaacaugaucagccgcaugcugaucaaccgguucaccaugaagcacaagaaggccaccuacgagccggacgucgaccugggcuccgggacgcgcaacaucggcaucgagaacgagauccccaaccucgacaucaucgggaagcggaucgagaagaucaagcaggagcacgagaucagcuggcacuacgaccaggaccaccccuacaagaccugggccuaccacggcuccuacgagaccaagcagaccggcagcgccuccagcauggugaacggggugguccgccugcugacgaagcccugggacguggugccgauggucacccagauggcgaugaccgacaccacgcccuucggccagcagcgcguguucaaggagaagguggacacccggacccaggagcccaaggaggggaccaagaagcucaugaagaucacggccgaguggcuguggaaggagcugggcaagaagaagacgccccgcaugugcacccgggaggaguucacccgcaagguccgguccaacgccgcccucggcgccaucuucacggacgagaacaaguggaaguccgcgcgcgaggccguggaggacgggcgguucugggagcugguggaccgcgagcggaaccugcaccucgagggcaagugcgagaccugcgucuacaacaugauggggaagcgcgagaagaagcugggcgaguucgggaaggccaagggcucccgggccaucugguacauguggcugggcgcgcgcuuccucgaguucgaggcccugggguuccugaacgaggaccacugguucagccggggcaacagccucuccgggguggagggcgaggggcugcaccgccugggcuacauccuccgggacgucggcaagaaggagggcggcgccauguacgccgacgacaccgccgggugggacacccgcaucacgcuggaggaccugaagaacgaggagauggugaccaaccacaugaagggcgagcacaagaagcucgcggaggccaucuucaagcugaccuaccagaacaaggugguccgggugcagcgcccgacgccccgggggacggugauggacaucaucagccgccgggaccagcgcggcuccggccaggucgggaccuacggccugaacaccuucaccaacauggaggcccagcucauccgccagauggagggggagggcaucuucaagagcauccagcaccugacggccaccgaggagaucgccgugcagaacuggcuggcgcgggugggccgcgagcggcucucccgcauggccaucagcggggacgacugcgucgugaagcccaucgacgaccgguucgccuccgcccugaccgcccugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggaaccaggacgagcugaucgggcgcgcgcggaucagccagggcgccggcuggucccucaaggagacggccugccugggcaagagcuacgcccagauguggacccugauguacuuccaccgccgggaccuccgccuggccgcgaacgccaucugcuccgccgugcccagccacuggguccccaccucccggaccaccuggagcauccacgccaagcacgaguggaugacgaccgaggacaugcuggcgguguggaaccgcguguggauccaggagaacccguggauggaggacaagacccccgucgaguccugggaggaggugcccuaccucggcaagcgggaggaccaguggugcgggagccugaucggccugaccagccgcgccacgugggccaagaacauccagaccgccaucaaccaggugcggucccucaucgggaacgaggaguacaccgacuacaugcccagcaugaagcgcuuccgccgggaggaggaggaggccggcguccugugguga

SEQ ID NO: 9236 - RNA, 9876 nt, Artificial Sequence
  derived and/or modified CDS sequence (opt1) from DENV-2__FJ850050__SS-prME
accgccggcgugaucgucaugcugauccccaccgccauggcguuccaccucacgacccgcaacggggagccgcacaugaucgugggccggcaggagaaggggaagagccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacuccaccagcaccugggucacguacggcaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcucuucggcaaggggggcaucgucaccugcgcgauguucaccugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcuccccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccgggggcacggagauccagaugagcagcggcaaccugcucuucaccgggcaccugaagugccgccugcggauggacaagcuccagcugaagggcauguccuacagcaugugcaccgggaaguucaagaucgugaaggagaucgccgagacccagcacggcacgaucgugauccgcguccaguacgagggcgacgggucccccugcaagauccccuucgagaucaccgaccuggagaagcggcacgugcucggccgccugaucaccgugaacccgaucgucaccgagaaggacagccccgugaacaucgaggccgagccccccuucggggacuccuacaucaucaucggcguggagccggggcagcugaagcucaacugguucaagaagggcagcuccaucggccagauguucgagacgaccaugcgcggggcgaagcggauggccauccugggcgacaccgccugggacuucgggagccugggcggggucuucaccuccaucggcaaggcccuccaccagguguucggcgccaucuacggggcggccuucagcggcguguccuggacgaugaagauccugaucggggucaucaucaccuggaucggcaugaacagccgcuccaccagccuguccgugagccuggugcucgucgggguggugacccuguaccugggcgccgucgugcaggccgacuccggcugcguggucagcuggaagaacaaggagcucaagugcggguccggcaucuucaucacggacaacgugcacaccuggaccgagcaguacaaguuccagcccgagagccccagcaagcuggcguccgccauccagaaggcccacgaggaggggaucugcggcauccggagcgugacccgccuggagaaccucauguggaagcagaucacgcccgagcugaaccacauccuguccgagaacgaggucaagcucaccaucaugaccggggacaucaagggcaucaugcaggccggcaagcggagccugcgcccgcagcccaccgagcugaaguacuccuggaagacgugggggaaggccaagaugcucagcaccgagucccacaaccagaccuuccugaucgacggccccgagaccgcggagugcccgaacacgaaccgggccuggaacagccuggagguggaggacuacggguucggcguguucaccaccaacaucuggcucaagcugcgcgagaagcaggacgucuucugcgacuccaagcugaugagcgccgccaucaaguacaaccgggccgugcacgcggacaugggcuacuggaucgaguccgcccccugcgacagcugggagaugcagaaggccuccuucaucgaggugaucagcugccacuggcccaagucccucacccuguggagcaacgggguccuggaguccgagaugaucauccccaagaacuucgccggcccggugagccagcacaacuaccgccccggguaccacacccagacggccggccccuggcaccucgggaagcuggagauggacuucgacuucugcgagggcaccaccguggucgugaccgaggacugcggcaaccgggggcccagccugcgcacgaccaccgcguccggcaagcucaucaccgaguggugcugccggagcugcacgcugccgccccugcgcuaccggggggaggacggcugcugguacgggauggagauccgcccccucaaggagaaggaggagaaccuggugaacucccuggucaccgccggccacggccagaucgacaacuucagccucggggugcugggcauggcccuguuccucgaggagaugcugcggacccgcaucgggaccaagcacgccauccugcucguggcggucuccuucgugacgcugaucaccggcaacaugagcuuccgggaccuggggcgcgugauggucauggugggcgccaccaugaccgacgacaucggcaugggggugacguaccucgcccugcuggccgccuucaagguccgccccaccuucgcggccggccuccugcugcggaagcucaccuccaaggagcugaugauggccaccaucgggaucgcccugcucagccaguccacgaucccggagaccauccuggagcugaccgacgcccucgcgcugggcaugauggugcugaagaucgugcgcaacauggagaaguaccagcucgccgucaccaucauggccaucagcugcgugcccaacgccgugauccugcagaacgccuggaaggucuccugcacgauccuggcggccgugagcgucuccccccuccugcugaccagcucccagcagaaggccgacuggaucccccucgcccugaccaucaagggccugaacccgaccgcgaucuuccucacgacccugagccggaccuccaagaagcgcagcuggccccugaacgaggccaucauggccguggggaugguguccauccucgccagcagccugcugaagaacgacauccccaugaccggcccccucgucgccgggggccugcugacggugugcuacgugcucaccgggcgguccgcggaccuggagcuggagcgcgccgccgacgucaagugggaggaccaggccgagaucagcggcuccagcccgauccucuccaucaccaucagcgaggacggcuccaugagcaucaagaacgaggaggaggagcagacccugacgauccugauccggaccgggcuccuggugaucuccggcguguuccccgucagcauccccaucaccgccgcggccugguaccugugggaggugaagaagcagcgcgccggggugcucugggacguccccuccccgccccccguggagaaggccgagcuggaggacggcgccuaccggaucaagcagcgcgggauccugggcuacagccagaucggcgcggggguguacaaggagggcaccuuccacaccauguggcacgucacgcggggggccgugcucaugcaccgcggcaagcggaucgagccguccugggccgacgugaagaaggaccugaucagcuacgggggcggcuggaagcuggagggggaguggaaggagggcgaggagguccaggugcucgcccuggagcccgggaagaacccccgcgccgugcagaccaagcccggcaucuucaagaccaacaccgggacgaucggcgcggucucccuggacuucagcccgggcaccuccgggagccccaucguggaccggaagggcaagguggucgggcucuacggcaacggcguggugacccgcuccggggccuacgucagcgccaucgcccagaccgagaagagcaucgaggacaaccccgagaucgaggacgacaucuuccggaagaagcgccugacgaucauggaccugcaccccggcgcggggaagaccaagcgguaccucccggccaucgugcgcgaggccaucaagcggggccugcgcacccugauccuggcccccacccgcguggucgccgcggagauggaggaggcccuccgggggcugcccauccgcuaccagacgcccgccaucaagaccgagcacaccggccgggagaucguggaccugaugugccacgccaccuucacgaugcgccuccuguccccggugcggguccccaacuacaaccugaucaucauggacgaggcccacuucaccgaccccgcgagcaucgccgcccgcggcuacaucuccacccggguggagaugggggaggccgccggcaucuucaugaccgcgacgcccccggggagccgcgaccccuucccccaguccaacgcccccaucauggacgaggagcgggagaucccggagcgcagcuggaacuccggccacgagugggugaccgacuucaaggggaagaccgucugguucgugcccagcaucaaggccggcaacgacaucgccgcgugccuccggaagaacggcaagaaggugauccagcugucccgcaagaccuucgacagcgaguacgucaagacgcgggccaacgacugggacuucguggugaccaccgacaucuccgagaugggggccaacuucaaggccgagcgcgucaucgacccccggcgcugcaugaagcccgugauccugaccgacggcgaggagcgggugauccucgccgggccgaugcccgucacgcacagcuccgcggcccagcgccggggccgcaucgggcgcaaccccaagaacgagaacgaccaguacaucuacaugggcgagccccuggagaacgacgaggacugcgcccacuggaaggaggccaagaugcugcucgacaacaucaacaccccggagggcaucauccccagcauguucgagcccgagcgggagaagguggacgccaucgacggggaguaccgccugcggggcgaggcgcgcaagaccuucguggaccugaugcggcgcggggaccucccggucuggcuggccuacaagguggccgccgagggcaucaacuacgccgaccggaaguggugcuucgacgggaucaagaacaaccagauccuggaggagaacaugcaggagcagaucuggaccaaggagggcgagcgcaagaagcucaagccccgguggcuggacgcgcgcaucuacuccgacccccuggcccucaaggaguucaaggaguucgccgccggccggaagagccugacgcugaaccucaucaccgagauggggcgccugcccaccuucaugacccagaaggcgcggaacgcccuggacaaccucgccgugcugcacacggccgaggccggcgggcgcgcguacaaccacgcccuguccgagcucccggagacccuggagacccugcuccugcugacccuccuggccacggucaccggcggcaucuuccuguuccucaugagcgggaagggcaucgggaagaugacccugggcaugugcugcaucaucaccgccuccauccugcucugguacgcccagauccagccccacuggaucgcggccagcaucauccuggaguucuuccugaucgugcuccugauccccgagcccgagaagcagcggaccccgcaggacaaccagcugacguacgucgugaucgccauccucaccguggucgccgccaccauggcgaacgagaugggguuccuggagaagaccaagaaggaccugggccucggcagcaucacgacccaggaguccgagagcaacauccuggacaucgaccugcgccccgccuccgccuggacccucuacgccguggccaccacguucgugacccccaugcugcggcacagcaucgagaacuccagcgucaacgugucccugaccgcgaucgccaaccaggccaccgugcucauggggcugggcaagggguggccccugagcaagauggacaucggcgucccgcuccuggccaucgggugcuacucccaggugaaccccaucacgcugaccgcggcccuccugcugcucguggcccacuacgccaucaucggccccggccugcaggccaaggcgacccgcgaggcccagaagcgggccgccgccgggaucaugaagaaccccaccgucgacggcaucacggugaucgaccuggagccgauccccuacgaccccaaguucgagaagcagcucgggcaggugaugcugcugauccucugcgucacccaggugcugaugaugcgcaccaccugggcgcugugcgaggcccucacgcuggccaccggccccaucagcacccugugggaggggaacccgggccgguucuggaacaccacgaucgccguguccauggccaacaucuuccgcggcagcuaccucgcgggggccggccugcuguucuccaucaugaagaacaccaccagcacccgccgggggacgggcaacaucggcgagacccucggggagaaguggaagucccgccugaacgcccugggcaagagcgaguuccagaucuacaagaaguccgggauccaggaggucgaccggacccucgccaaggagggcaucaagcgcggggagaccgaccaccacgcggugagccggggcuccgccaagcugcgcugguucguggagcggaacauggucacgcccgagggcaaggugguggaccuggggugcggccgcgggggcuggagcuacuacugcgggggccucaagaacguccgggaggugaagggccugaccaaggggggccccgggcacgaggagcccaucccgaugagcaccuacggcuggaaccuggugcgccuccaguccggggucgacguguucuucaccccccccgagaagugcgacacgcugcugugcgacaucggcgagagcucccccaacccgaccaucgaggccggccggacccuccgcgugcugaaccuggucgagaacuggcucaacaacaacacccaguucugcaucaaggugcugaaccccuacaugcccagcgugaucgagaagauggaggcccugcagcggcaguacgggggcgcccucguccgcaacccgcugucccggaacagcacccacgagauguacuggguguccaacgcgacggggaacaucgugagcuccgucaacaugaucagccgcaugcugaucaaccgguucaccaugaagcacaagaaggccaccuacgagcccgacguggaccugggcuccgggacccgcaacaucggcaucgagagcgagauccccaaccucgacaucaucggcaagcggaucgagaagaucaagcaggagcacgagaucuccuggcacuacgaccaggaccaccccuacaagacgugggccuaccacgggagcuacgagaccaagcagaccggcuccgccagcuccauggugaacggggucgugcgccugcugaccaagccgugggacgugguccccauggugacgcagauggccaugaccgacaccacccccuucggccagcagcgcguguucaaggagaaggucgacacgcggacccaggagcccaaggagggcaccaagaagcucaugaagaucaccgcggaguggcuguggaaggagcuggggaagaagaagacgccgcgcaugugcacccgggaggaguucaccaagaaggugcgcagcaacgccgcccucggcgccaucuucaccgacgagaacaaguggaaguccgcccgggaggcgguggaggacgggcgcuucugggagcuggucgaccgggagcgcaaccugcaccucgagggcaagugcgagacgugcguguacaacaugauggggaagcgggagaagaagcugggcgaguucggcaaggccaaggggagccgcgccaucugguacauguggcugggcgcccgguuccucgaguucgaggcgcugggguuccugaacgaggaccacugguucagccgcggcaacucccucagcgggguggagggcgagggccugcaccggcugggguacauccuccgcgacgucggcaagaaggaggggggcgccauguacgccgacgacaccgccgggugggacacccggaucacccuggaggaccugaagaacgaggagauggugacgaaccacaugaagggcgagcacaagaagcucgccgaggcgaucuucaagcugaccuaccagaacaaggucgugcgcgugcagcggcccaccccccgcggcaccgucauggacaucaucucccggcgcgaccagcgggggagcggccagguggggacguacggccugaacaccuucaccaacauggaggcccagcucauccgccagauggagggcgaggggaucuucaaguccauccagcaccugaccgccacggaggagaucgccgugcagaacuggcuggcccgcgucggccgggagcgccucagccggauggcgaucuccggggacgacugcguggugaagcccaucgacgaccgcuucgccagcgcccugaccgcccugaacgacaugggcaagguccggaaggacauccagcagugggagccgucccgcggguggaacgacuggacccaggugcccuucugcagccaccacuuccacgagcucgugaugaaggacggccggguccugguggugcccugccgcaaccaggacgagcugaucggccgggcccgcaucucccagggggcgggcuggagccucaaggagaccgccugccuggggaaguccuacgcccagauguggacgcugauguacuuccaccggcgcgaccuccggcuggccgccaacgcgaucugcagcgccguccccucccacugggugccgaccagccgcaccaccugguccauccacgccaagcacgaguggaugaccacggaggacaugcuggccguguggaaccgggucuggauccaggagaaccccuggauggaggacaagacccccguggagagcugggaggaggugcccuaccucggcaagcgcgaggaccaguggugcgggagccugaucggccugaccucccgggcgaccugggccaagaacauccagacggccaucaaccagguccgcagccucaucggcaacgaggaguacaccgacuacaugccguccaugaagcgguuccgccgcgaggaggaggaggccggggugcugugguga

SEQ ID NO: 9237 - RNA, 9876 nt, Artificial Sequence
  derived and/or modified CDS sequence (opt1) from DENV-2__FJ639837__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagauggugauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcaucggcacgaagcacgcgauccugcucgucgccgugagcuucgugacccugaucaccgggaacauguccuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucguccgcaacauggagaaguaccagcucgccgugacgaucauggccaucuccugcgugccgaacgccgucauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggucagcauccucgccuccagccugcugaagaacgacauccccaugacggggccccucguggcgggcgggcugcugaccgugugcuacguccucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcggggucuucccgguguccauccccaucaccgcggccgccugguaccugugggaggugaagaagcagcgcgccggcguccucugggacgugcccagcccgccgcccguggagaaggccgagcuggaggacggggcguaccggaucaagcagcgcggcauccugggguacucccagaucggcgccggcgucuacaaggaggggaccuuccacacgauguggcacgugacccggggcgccgugcucaugcaccgcgggaagcggaucgagcccagcugggccgacgucaagaaggaccugaucuccuacggcgggggcuggaagcuggagggcgaguggaaggagggggaggagguccaggugcucgcccuggagcccggcaagaacccccgcgcgguccagaccaagcccgggaucuucaagaccaacacgggcaccaucggggccgugagccuggacuucucccccggcaccagcggcucccccaucguggaccggaaggggaaggucgugggccucuacgggaacggcguggucacccgcagcggcgccuacguguccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcgucguggcggccgagauggaggaggcccuccggggccugcccauccgcuaccagacccccgccaucaagaccgagcacaccgggcgggagaucguggaccugaugugccacgccacguucaccaugcgccuccugagccccguccgggugccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgcggccugccuccggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccugacggacggggaggagcgggucauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucgucgaccugaugcggcgcggcgaccuccccguguggcuggccuacaagguggccgccgaggggaucaacuacgcggaccggaaguggugcuucgacggcaucaagaacaaccagauccuggaggagaacauggaggucgagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccgugcugcacaccgccgaggccgggggccgcgccuacaaccacgcccugagcgagcuccccgagacccuggagacccugcuccugcugacgcuccuggccaccgucaccgggggcaucuuccuguuccucauguccggcaagagcaucgggaagaugacccugggcaugugcugcaucaucaccgccuccauccugcucuggcacgcgcagauccagccgcacuggaucgccgccagcaucauccuggaguucuuccugaucgugcuccugauccccgagcccgagaagcagcggacgccccaggacaaccagcugaccuacguggucaucgccauccucaccgugguggccgcgaccauggccaacgagaugggguuccuggagaagacgaagaaggaccugggccucgggagcaucaccacccaggaguccgagagcaacauccuggacaucgaccugcgcccggccuccgccuggacccucuacgccgucgcgacgaccuucgugacccccaugcugcggcacagcaucgagaacuccagcgugaacgucucccugaccgccaucgccaaccaggccacggugcucaugggccugggcaagggguggccccugagcaagauggacaucggcgugccccuccuggcgaucgggugcuacucccaggucaacccgaucacccugaccgccgcccuccugcugcucguggcccacuacgccaucaucggccccgggcugcaggcgaaggccacccgcgaggcccagaagcgggccgccgcgggcaucaugaagaaccccacgguggacggcaucaccgucaucgaccuggcccccaucccguacgaccccaaguucgagaagcagcucggccaggugaugcugcugauccucugcgugacccagguccugaugaugcgcaccacgugggcccugugcgaggcccucacccuggccaccggccccaucagcacccugugggaggggaaccccggccgguucuggaacacgaccaucgcgguguccauggccaacaucuuccgcgggagcuaccucgccggcgccggccugcuguucuccaucaugaagaacaccaccagcacgcgccgggggaccggcaacaucggggagacccucggcgagaaguggaagucccgccugaacgcgcugggcaagagcgaguuccagaucuacaagaaguccgggauccaggagguggaccggacccucgccaaggagggcaucaagcgcggggagacggaccaccacgccgucagccggggcuccgccaagcugcgcugguucguggagcggaacauggugaccccggaggggaaggucguggaccugggcugcggccgcgggggcuggagcuacuacugcgggggccucaagaacgugcgggaggucaaggggcugaccaagggcggccccgggcacgaggagcccauccccaugagcaccuacggcuggaaccuggugcgccuccaguccgggguggacgucuucuucacgccgcccgagaagugcgacacccugcugugcgacaucggcgagagcucccccaaccccaccaucgaggccgggcggacccuccgcgugcugaaccugguggagaacuggcucaacaacaacacccaguucugcaucaagguccugaacccguacaugcccagcgugaucgagaagauggaggcgcugcagcggcaguacggcggcgcccucgugcgcaacccccugucccggaacagcacgcacgagauguacugggucuccaacgccaccgggaacaucgugagcuccgugaacaugaucagccgcaugcugaucaaccgguucaccaugaagcacaagaaggccaccuacgagccggacgucgaccugggcuccgggacgcgcaacaucggcaucgagaacgagauccccaaccucgacaucaucgggaagcggaucgagaagaucaagcaggagcacgagaucagcuggcacuacgaccaggaccaccccuacaagaccugggccuaccacggcuccuacgagaccaagcagaccggcagcgcguccagcauggugaacggggugguccgccugcugacgaagcccugggacguggugccgauggucacccagauggccaugaccgacaccacgcccuucggccagcagcgcguguucaaggagaagguggacacccggacccaggagcccaaggaggggaccaagaagcucaugaagaucacggccgaguggcuguggaaggagcugggcaagaagaagacgccccgcaugugcacccgggaggaguucacccgcaagguccgguccaacgccgcccucggcgcgaucuucacggacgagaacaaguggaaguccgcccgcgaggccguggaggacgggcgguucugggagcugguggaccgcgagcggaaccugcaccucgagggcaagugcgagaccugcgucuacaacaugauggggaagcgcgagaagaagcugggcgaguucgggaaggccaagggcucccgggcgaucugguacauguggcugggcgcccgcuuccucgaguucgaggcccugggguuccugaacgaggaccacugguucagccggggcaacagccucuccgggguggagggcgaggggcugcaccgccugggcuacauccuccgggacgucgccaagaaggagggcggggccauguacgcggacgacaccgccggcugggacacccgcaucacgcuggaggaccugaagaacgaggagauggugaccaaccacaugaagggggagcacaagaagcucgccgaggccaucuucaagcugaccuaccagaacaaggugguccgggugcagcgcccgacgccccggggcacggugauggacaucaucagccgccgggaccagcgcggguccggccaggucggcaccuacgggcugaacaccuucaccaacauggaggcccagcucauccgccagauggagggcgaggggaucuucaagagcauccagcaccugacggcgaccgaggagaucgccgugcagaacuggcuggcccgggugggccgcgagcggcucucccgcauggccaucagcggcgacgacugcgucgugaagcccaucgacgaccgguucgccuccgcgcugaccgcccugaacgacauggggaaggugcgcaaggacauccagcagugggagcccagccggggcuggaacgacuggacccaggucccguucugcucccaccacuuccacgagcucgugaugaaggacgggcgcgugcuggucgugcccugccggaaccaggacgagcugaucggccgcgcccggaucagccagggggccggcuggucccucaaggagacggccugccugggcaagagcuacgcgcagauguggacccugauguacuuccaccgccgggaccuccgccuggccgccaacgccaucugcuccgcggugcccagccacuggguccccaccucccggaccaccuggagcauccacgccaagcacgaguggaugacgaccgaggacaugcuggccguguggaaccgcguguggauccaggagaacccguggauggaggacaagacccccgucgaguccugggaggaggugcccuaccucgggaagcgggaggaccaguggugcggcagccugaucgggcugaccagccgcgccacgugggccaagaacauccagaccgcgaucaaccaggugcggucccucaucggcaacgaggaguacaccgacuacaugcccagcaugaagcgcuuccgccgggaggaggaggaggccgggguccugugguga

SEQ ID NO: 9238 - RNA, 9876 nt, Artificial Sequence
  derived and/or modified CDS sequence (opt1) from DENV-2__FJ744706__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgggucccacaaccagaccuuccugaucgacggccccgagaccgccgagugcccgaacacgaaccgggccuggaacagccuggagguggaggacuacggguucggcguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacgggguccuggagagcgagaugaucauccccaagaacuucgccggccccgugucccagcacaacuaccgcccgggguaccacacgcagaccgcgggccccuggcaccucgggaagcuggagauggacuucgacuucugcgagggcaccaccguggucgugacggaggacugcggcaaccgggggcccagccugcgcaccaccaccgccagcggcaagcucaucacggaguggugcugccgguccugcacccugcccccgcugcgcuaccgcggggaggacggcugcugguacgggauggagauccgcccccucaaggagaaggaggagaaccuggugaacagccuggucaccgccggccacggccagaucgacaacuucucccucggggugcugggcauggcccuguuccucgaggagaugcugcggacccgcaucgggacgaagcacgcgauccugcucguggccgucagcuucgugacccugaucaccggcaacauguccuuccgggaccuggggcgcgugauggucauggugggcgccaccaugacggacgacaucggcaugggggugaccuaccucgcccugcuggccgcguucaagguccgccccaccuucgccgccggccuccugcugcggaagcucaccagcaaggagcugaugauggccacgaucgggaucgcccugcucucccagagcaccauccccgagaccauccuggagcugaccgacgcgcucgcccugggcaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccguggggauggugagcauccucgccuccagccugcugaagaacgacauccccaugacgggcccccucgucgccgggggccugcugaccgugugcuacgugcucaccgggcggagcgccgaccuggagcuggagcgcgccgccgacgucaagugggaggaccaggccgagaucuccggcagcucccccauccucagcaucaccaucuccgaggacggcagcauguccaucaagaacgaggaggaggagcagacgcugaccauccugauccggaccgggcuccuggugaucagcggcguguucccggucuccauccccaucaccgcggccgccugguaccugugggaggugaagaagcagcgcgccggggugcucugggacguccccagcccgccgcccguggagaaggccgagcuggaggacggcgcguaccggaucaagcagcgcgggauccugggcuacucccagaucggcgccgggguguacaaggagggcaccuuccacacgauguggcacgucacccgcggggcggugcucaugcaccggggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgcggugcagaccaagcccggcaucuucaagaccaacacggggaccaucggcgccgucagccuggacuucucccccggcaccagcgggucccccaucguggaccggaagggcaagguggucgggcucuacggcaacggcguggugacccgcagcggggccuacgucuccgccaucgcgcagacggagaaguccaucgaggacaaccccgagaucgaggacgacaucuuccggaagaagcgccugaccaucauggaccugcaccccggcgccgggaagaccaagcgguaccuccccgccaucgugcgcgaggccaucaagcggggccugcgcacccugauccuggccccgacgcgcguggucgcggccgagauggaggaggcccuccgggggcugcccauccgcuaccagacccccgccaucaagaccgagcacaccggccgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggggaggccgcgggcaucuucaugacggccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccuccggaagaacggcaagaaggugauccagcugagccgcaagacguucgacuccgaguacgucaagacccgggccaacgacugggacuucguggugaccaccgacaucagcgagaugggggccaacuucaaggccgagcgcgucaucgacccccggcgcugcaugaagcccgugauccugacggacggcgaggagcgggugauccucgcggggcccaugccggucacccacuccagcgccgcccagcgccggggccgcaucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaagguggacgcgaucgacggggaguaccgccugcggggcgaggcccgcaagaccuucguggaccugaugcggcgcggggaccuccccgucuggcuggccuacaagguggccgccgagggcaucaacuacgcggaccggaaguggugcuucgacgggaucaagaacaaccagauccuggaggagaacauggagguggagaucuggacgaaggagggcgagcgcaagaagcucaagccgcgguggcuggacgcccgcaucuacagcgacccccuggcccucaaggaguucaaggaguucgccgcgggccggaagucccugacccugaaccucaucaccgagauggggcgccugcccaccuucaugacgcagaaggcccggaacgcccuggacaaccucgccguccugcacaccgccgaggcgggcgggcgcgccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggguuccuggagaagacgaagaaggaccugggccucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucauggggcugggcaagggguggccccuguccaagauggacaucggcgugccccuccuggcgaucgggugcuacagccaggugaacccgaucacccugaccgccgcccuccugcugcucgucgcccacuacgccaucaucggccccggccugcaggcgaaggccacccgcgaggcccagaagcgggccgccgcggggaucaugaagaaccccacgguggacggcaucaccgugaucgaccuggagcccaucccguacgaccccaaguucgagaagcagcucgggcaggucaugcugcugauccucugcgugacccaggugcugaugaugcgcaccacgugggcccugugcgaggcccucacccuggccaccggccccaucuccacccugugggaggggaaccccggccgguucuggaacacgaccaucgccgucagcauggcgaacaucuuccgcggcuccuaccucgccggggccggccugcuguucagcaucaugaagaacaccaccuccacgcgccgggggaccggcaacaucggcgagacccucggggagaaguggaagucccgccugaacgcccugggcaaguccgaguuccagaucuacaagaaguccgggauccaggagguggaccggacccucgcgaaggagggcaucaagcgcggggagacggaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugaccaagggcggccccgggcacgaggagcccauccccaugagcaccuacggcuggaaccugguccgccuccagagcgggguggacguguucuucacgccgcccgagaagugcgacacccugcugugcgacaucggcgaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacgggggcgcgcucgugcgcaacccccugagccggaacuccacgcacgagauguacugggugagcaacgccaccgggaacaucgucuccagcgugaacaugaucucccgcaugcugaucaaccgguucaccaugaagcacaagaaggccaccuacgagccggacguggaccugggcagcgggacgcgcaacaucggcaucgaguccgagauccccaaccucgacaucaucggcaagcggaucgagaagaucaagcaggagcacgagaucagcuggcacuacgaccaggaccaccccuacaagaccugggccuaccacggguccuacgagaccaagcagaccggcagcgccuccagcauggucaacgggguggugcgccugcugacgaagcccugggacgucgugccgauggugacccagauggcgaugaccgacaccacgcccuucggccagcagcgcgucuucaaggagaagguggacacccggacccaggagcccaaggagggcaccaagaagcucaugaagaucacggccgaguggcuguggaaggagcuggggaagaagaagacgccccgcaugugcacccgggaggaguucaccaagaaggugcgcggcaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggcgaguucgggaaggccaagggcagccgcgccaucugguacauguggcugggggcgcgguuccucgaguucgaggcccugggcuuccugaacgaggaccacugguucucccgcgggaacagccucagcggcgucgagggcgaggggcugcaccggcugggcuacauccuccgcgacguggggaagaaggagggcggggccauguacgccgacgacaccgccggcugggacacccggaucacgcuggaggaccugaagaacgaggagauggucaccaaccacaugaagggcgagcacaagaagcucgcggaggccaucuucaagcugaccuaccagaacaagguggugcgcguccagcggccgacgccccgcgggacggugauggacaucaucucccggcgcgaccagcggggcagcggccagguggggaccuacggccugaacaccuucaccaacauggaggcccagcucauccgccagauggagggggagggcaucuucaaguccauccagcaccugacggccaccgaggagaucgccguccagaacuggcuggcgcgcguggggcgggagcgccucagccggauggccaucuccggcgacgacugcguggucaagcccaucgacgaccgcuucgccagcgcccugaccgcccugaacgacauggggaaggugcggaaggacauccagcagugggagcccucccgcggcuggaacgacuggacccaggugccguucugcagccaccacuuccacgagcucgucaugaaggacggccgggugcuggugguccccugccgcaaccaggacgagcugaucgggcgggcgcgcaucucccagggcgccggguggagccucaaggagacggccugccugggcaaguccuacgcccagauguggacccugauguacuuccaccggcgcgaccuccggcuggccgcgaacgccaucugcagcgccgugcccucccacugggugcccaccagccgcaccaccugguccauccacgccaagcacgaguggaugacgaccgaggacaugcuggcggucuggaaccggguguggauccaggagaacccguggauggaggacaagacccccguggagagcugggaggagguccccuaccucgggaagcgcgaggaccaguggugcggcucccugaucggccugaccagccgggccacgugggccaagaacauccagaccgccaucaaccaggugcgcagccucaucgggaacgaggaguacaccgacuacaugcccuccaugaagcgguuccgccgcgaggaggaggaggccggcgugcugugguga

SEQ ID NO: 9239 - RNA, 9876 nt, Artificial Sequence
  derived and/or modified CDS sequence (opt1) from DENV-2__FJ744707__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucacgccgcccgagaagugcgacacccugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucaccaagaaggugcgcuccaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggccgacgccccgcggcacggugauggacaucaucagccggcgcgaccagcggggcuccgggcaggucggcaccuacgggcugaacaccuucaccaacauggaggcccagcucauccgccagauggagggcgagggcaucuucaagagcauccagcaccugacggccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcugguggcgcccugccgcaaccaggacgagcugaucggccgggcccgcaucagccagggcgccggguggucccucaaggagacggccugccugggcaagagcuacgcccagauguggacccugauguacuuccaccggcgcgaccuccggcuggcggccaacgccaucugcuccgccguccccagccacugggugcccaccucccgcaccaccuggagcauccacgcgaagcacgaguggaugacgaccgaggacaugcuggccguguggaaccgggucuggauccaggagaacccguggauggaggacaagacccccguggaguccugggaggaggugcccuaccucgggaagcgcgaggaccaguggugcggcagccugaucgggcugaccagccgggccacgugggccaagaacauccagaccgccaucaaccagguccgcucccucaucggcaacgaggaguacaccgacuacaugcccagcaugaagcgguuccgccgcgaggaggaggaggcgggcgugcugugguga

SEQ ID NO: 9240 - RNA, 9876 nt, Artificial Sequence
  derived and/or modified CDS sequence (opt1) from DENV-2__FJ744704__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggauguucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagacccccgccaucaagaccgagcacaccgggcgcgagaucgucgaccucaugugccacgccacguucaccaugcggcugcugagccccgugcgcgugccgaacuacaaccucaucaucauggacgaggcgcacuucaccgaccccgccuccaucgccgcccggggcuacaucagcacccgcgucgagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccccgccggugcaugaagcccgucauccucacggacggggaggagcgcgugauccuggcgggccccaugccggugacccacuccagcgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccggccggccagcgccuggacccuguacgccguggcgacgaccuucgugacccccaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgggaggcccagaagcgcgccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggaggucgaccgcacccuggcgaaggaggggaucaagcggggcgagacggaccaccacgccgugagccgcggguccgccaagcugcggugguucguggagcgcaacauggucaccccggagggcaaggugguggaccucggcugcgggcggggcggguggagcuacuacugcggcgggcugaagaacguccgcgaggugaagggccugaccaagggcgggcccggccacgaggagcccauccccauguccaccuacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacccaguucugcaucaaggugcugaacccguacaugcccagcgugaucgagaagauggaggcccuccagcgcaaguacggcggggcgcugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagccggacguggaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacguggucccgauggugacccagauggcgaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaucugcacccgcgaggaguucacgcggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgagaacagccugagcgggguggagggcgaggggcugcaccggcucggcuacauccugcgcgacgucggcaagaaggagggcggcgccauguacgccgacgacaccgccgggugggacacgcggaucacccuggaggaccucaagaacgaggagauggugaccaaccacaugaagggcgagcacaagaagcuggcggaggccaucuucaagcugaccuaccagaacaaggucgugcgcgugcagcggccgacgccccgcgggaccgucauggacaucaucucccggcgcgaccagcgcggcagcggccagguggggaccuacggccucaacaccuucacgaacauggaggcccagcugauccggcagauggagggggagggcaucuucaaguccauccagcaccugaccgccaccgaggagaucgccgugcagaacuggcucgcgcgcgucggccgggagcgccugagccggauggccaucuccggggacgacugcguggugaagcccaucgacgaccgcuucgccagcgcccugaccgcccucaacgacaugggcaagguccggaaggacauccagcagugggagcccucccgcggguggaacgacuggacccaggucccguucugcagccaccacuuccacgagcuggugaugaaggacggccggguccugguggugcccugccgcaaccaggacgagcucaucgggcgggcgcgcaucucccagggcgccggcuggagccugaaggagaccgccugccuggggaaguccuacgcccagauguggacccucauguacuuccaccggcgcgaccugcggcuggccgcgaacgccaucugcagcgccgugccgccccacugggugccgaccucccgcaccacguggagcauccacgccaagcacgaguggaugaccaccgaggacaugcucgcgguguggaaccgggucuggauccaggagaaccccuggauggaggacaagacccccguggaguccugggaggaggugcccuaccugggcaagcgcgaggaccaguggugcgggagccugaucggccucacgucccgggccaccugggccaagaacauccagaccgccaucaaccagguccgcagccugaucgggaacgaggaguacaccgacuacaugccgagcaugaagcgcuuccggcgcgaggaggaggaggccggcgugcugugguga

SEQ ID NO: 9241 - RNA, 9876 nt, Artificial Sequence
  derived and/or modified CDS sequence (opt1) from DENV-2__FJ744745__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugaagauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacauccgcgggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcacgcuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccgcccggccagcgccuggacgcuguacgccguggcgaccaccuucgugacccccaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacgcgcgaggcccagaagcgggccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccacguacggguggaaccucgugcgccugcagagcggcgucgacguguucuucaccccgcccgagaagugcgacacccugcucugcgacaucggggagagcucccccaaccccaccaucgaggccggccggacccugcgcgugcugaaccucgucgagaacuggcugaacaacaacacgcaguucugcaucaaggugcugaacccguacaugcccagcgugaucgagaagauggaggcccuccagcggaaguacggcggggcgcugguccgcaacccccugucccggaacagcacccacgagauguacuggguguccaacgccagcggcaacaucguguccagcgucaacaugaucucccgcaugcugaucaaccgguucaccaugaagcacaagaaggccaccuacgagccggacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacguggucccgauggugacccagauggcgaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcgguccaacgccgcccugggggccaucuucaccgacgagaacaaguggaaguccgcgcgcgaggccguggaggacucccgguucugggagcuggucgaccgcgagcggaaccuccaccuggagggcaagugcgagaccugcguguacaacaugauggggaagcgcgagaagaagcugggcgaguucgggaaggccaagggcagccgggccaucugguacauguggcucggcgcgcgcuuccuggaguucgaggcccugggguuccucaacgaggaccacugguucagccggggcaacucccugagcgggguggagggcgaggggcugcaccgccucggcuacauccugcgggacgucggcaagaaggagggcggcgccauguacgccgacgacaccgccgggugggacacgcgcaucacccuggaggaccucaagaacgaggagauggugaccaaccacaugaagggcgagcacaagaagcuggcggaggccaucuucaagcugaccuaccagaacaaggucgugcgggugcagcgcccgacgccccgggggaccgucauggacaucaucucccgccgggaccagcgcggcagcggccagguggggaccuacggccucaacaccuucacgaacauggaggcccagcugauccgccagauggagggggagggcaucuucaaguccauccagcaccugaccgccaccgaggagaucgccgugcagaacuggcucgcgcgggucggccgcgagcggcugagccgcauggccaucuccggggacgacugcguggugaagcccaucgacgaccgguucgccagcgcccugaccgcccucaacgacaugggcaagguccgcaaggacauccagcagugggagcccucccggggguggaacgacuggacccaggucccguucugcagccaccacuuccacgagcuggugaugaaggacggccgcguccugguggugcccugccggaaccaggacgagcucaucgggcgcgcgcggaucucccagggcgccggcuggagccugaaggagaccgccugccuggggaaguccuacgcccagauguggacccucauguacuuccaccgccgggaccugcgccuggccgcgaacgccaucugcagcgccgugccgccccacugggugccgaccucccggaccacguggagcauccacgccaagcacgaguggaugaccaccgaggacaugcucgcgguguggaaccgcgucuggauccaggagaaccccuggauggaggacaagacccccguggaguccugggaggaggugcccuaccugggcaagcgggaggaccaguggugcgggagccugaucggccucacgagccgcgccaccugggccaagaacauccagaccgccaucaaccagguccggucccugaucgggaacgaggaguacaccgacuacaugccgagcaugaagcgcuuccgccgggaggaggaggaggccggcgugcugugguga

SEQ ID NO: 9242 - RNA, 9876 nt, Artificial Sequence
  derived and/or modified CDS sequence (opt1) from DENV-2__FJ744705__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacgacucccccugcaagauccccuucgagaucaccgaccuggagaagcggcacgugcucggccgccugaucaccgugaacccgaucgucaccgagaaggacagccccgugaacaucgaggcggagccgcccuucggggacuccuacaucaucaucggcguggagccggggcagcugaagcucaacugguucaagaagggcagcuccaucgggcagauguucgagacgaccaugcgcggcgccaagcggauggccauccugggcgacaccgccugggacuucgggagccugggcggggucuucaccuccaucggcaaggcccuccaccagguguucggggcgaucuacggcgccgccuucagcggcguguccuggacgaugaagauccugaucggggucaucaucaccuggaucggcaugaacagccgcuccaccagccuguccgugagccuggugcucgucgggguggugacccuguaccugggcgccaugguccaggcggacuccgggugcaucgugagcuggaagaacaaggagcucaagugcggcuccggcaucuucaucacggacaacgugcacaccuggaccgagcaguacaaguuccagcccgagagccccagcaagcuggccuccgccauccagaaggcccacgaggaggggaucugcggcauccggagcgucacccgccuggagaaccucauguggaagcagaucacgcccgagcugaaccacauccuguccgagaacgaggugaagcucaccaucaugaccggggacauccggggcaucaugcaggccgggaagcgcagccugcggccgcagcccaccgagcugaaguacuccuggaagacguggggcaaggcgaagaugcucagcaccgagucccacaaccagaccuuccugaucgacggccccgagaccguggagugcccgaacacgaaccgcgccuggaacagccuggaggucgaggacuacggguucggcguguucaccaccaacaucuggcucaagcugcgggagaagcaggacguguucugcgacuccaagcugaugagcgccgccaucaaggacaaccgcgccguccacgcggacaugggguacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccggccccgucucccagcacaacuaccggccgggguaccacacgcagaccgccggccccuggcaccucgggaagcuggagauggacuucgaccugugcgagggcaccaccgugguggucacggaggacugcgggaaccgcggccccagccuccggaccaccaccgcgagcggcaagcugaucacggaguggugcugccgcuccugcacccugcccccgcuccgguaccgcggggaggacggcugcugguacgggauggagauccggccccugaaggagaaggaggagaaccuggugaacagccucgugaccgccggccacgggcagaucgacaacuucucccugggcguccugggcauggcccucuuccuggaggagaugcugcgcacccggaucgggacgaagcacgccauccuccugguggcggugagcuucgucacccugaucaccggcaacauguccuuccgcgaccucgggcgcgugauggugauggucggcgccaccaugacggacgacaucgggaugggcgugaccuaccuggcccugcucgccgccuucaaggugcggcccaccuucgcggccggccugcugcuccgcaagcugaccagcaaggagcugaugauggccacgaucgggaucgcccuccugucccagagcaccauccccgagaccauccuggagcucaccgacgcccuggcgcugggcaugaugguccucaagaucgugcggaacauggagaaguaccagcuggccgugacgaucauggccaucuccugcgucccgaacgccgugauccugcagaacgccuggaaggugagcugcaccauccucgcggccgucuccgugagcccccugcugcucaccuccagccagcagaaggccgacuggaucccccuggcccugaccaucaaggggcucaaccccacggcgaucuuccugaccacccugucccgcaccagcaagaagcgguccuggccgcucaacgaggccaucauggccgucggcauggugagcauccuggccuccagccugcucaagaacgacauccccaugacgggcccccugguggccgggggccugcucaccgucugcuacgugcugaccgggcgcagcgcggaccuggagcucgagcgggccgccgacgugaagugggaggaccaggccgagaucuccggcagcucccccauccugagcaucaccaucuccgaggacgggagcauguccaucaagaacgaggaggaggagcagacgcugaccauccucauccgcaccggccugcuggucaucagcggcguguucccgguguccauccccaucaccgccgcggccugguaccucugggaggucaagaagcagcgggccggggugcugugggacgugcccagcccgccgcccgucgagaaggccgagcuggaggacggcgccuaccgcaucaagcagcgggggauccucggcuacucccagaucggggcgggcguguacaaggagggcaccuuccacacgauguggcacgugacccgcggggccguccugaugcaccggggcaagcgcaucgagcccagcugggccgacgugaagaaggaccugaucuccuacgggggcggguggaagcucgagggcgaguggaaggagggcgaggaggugcagguccuggcccuggagcccgggaagaacccccgggccgugcagaccaagcccggcaucuucaagaccaacacggggaccaucggcgcggugagccucgacuucucccccgggaccagcggcucccccaucgucgaccgcaagggcaaggugguggggcuguacggcaacggggucgugacccggagcggcgccuacguguccgccaucgcccagacggagaaguccaucgaggacaaccccgagaucgaggacgacaucuuccgcaagaagcggcugaccaucauggaccuccaccccggcgcggggaagaccaagcgcuaccugcccgccaucguccgggaggccaucaagcgcggccugcgcacccugauccucgccccgacgcgggugguggccgcggagauggaggaggcccugcgcgggcugcccauccgguaccagacccccgccaucaagaccgagcacaccggccgcgagaucgucgaccucaugugccacgccacguucaccaugcggcugcugagccccgugcgcgugccgaacuacaaccucaucaucauggacgaggcccacuucaccgaccccgcguccaucgccgcccggggguacaucagcacccgcgucgagaugggcgaggccgccggcaucuucaugacggcgacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgccgcgugccugcgcaagaacgggaagaaggugauccagcugagccggaagacguucgacuccgaguacgugaagacccgcgccaacgacugggacuucgucgugaccaccgacaucagcgagaugggcgccaacuucaaggccgagcgggugaucgacccccgccggugcaugaagcccgucauccucacggacggcgaggagcgcgugauccuggccgggcccaugccggugacccacuccagcgcggcccagcggcgcggccgcaucgggcggaaccccaagaacgagaacgaccaguacaucuacaugggcgagccccuggagaacgacgaggacugcgcccacuggaaggaggccaagaugcuccuggacaacaucaacacccccgaggggaucaucccguccauguucgagcccgagcgcgagaaggucgacgccaucgacggcgaguaccggcugcgcggcgaggcgcggaagaccuucguggaccucaugcgccgcggggaccugcccguguggcuggccuacaaggucgccgccgagggcaucaacuacgccgaccgcaaguggugcuucgacgggaucaagaacaaccagauccucgaggagaacauggagguggagaucuggacgaaggagggcgagcggaagaagcugaagccgcgcuggcuggacgcgcggaucuacagcgacccccucgcccugaaggaguucaaggaguucgccgccgggcgcaagucccugacccucaaccugaucaccgagaugggccggcugcccaccuucaugacgcagaaggcgcgcaacgcccucgacaaccuggccgugcugcacaccgccgaggccggcgggcgggcguacaaccacgcccucagcgagcugcccgagacccuggagacccuccugcugcucacgcugcuggccaccgucaccggcgggaucuuccucuuccugauguccggcaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcgcacgccccaggacaaccagcucaccuacgucgugaucgccauccugaccguggucgccgccaccauggcgaacgagaugggguuccuggagaagacgaagaaggaccucggccuggggagcaucaccacccaggagagcgaguccaacauccuggacaucgaccuccggccggccagcgccuggacccuguacgccguggccacgaccuucgugacccccaugcugcgccacuccaucgagaacagcuccgucaacgugagccucaccgcgaucgccaaccaggccacggugcugaugggccugggcaagggguggccccucuccaagauggacaucggcgucccccugcuggccaucgggugcuacagccaggugaacccgaucacccucaccgcggcccugcugcuccugguggcccacuacgccaucaucggccccgggcugcaggccaaggcgacccgggaggcccagaagcgcgccgccgccggcaucaugaagaaccccacggucgacggcaucaccgugaucgaccucgagcccaucccguacgaccccaaguucgagaagcagcuggggcaggucaugcugcucauccugugcgucacccaggugcugaugaugcggaccacgugggcgcucugcgaggcccugacccuggccaccggccccaucuccacccucugggaggggaaccccggccgcuucuggaacacgaccaucgccgugagcauggccaacaucuuccgcggguccuaccuggcgggcgccggccuccucuucagcaucaugaagaacaccaccaacacgcggcgcgggaccggcaacaucggggagacccugggcgagaaguggaagucccggcugaacgcccucggcaagagcgaguuccagaucuacaagaaguccgggauccaggaggucgaccgcacccuggccaaggagggcaucaagcgcggggagacggaccaccacgcggugagccgcggcuccgccaagcugcggugguucguggagcgcaacauggucaccccggaggggaaggugguggaccucggcugcggccgcggcggguggagcuacuacugcggcgggcugaagaacguccgcgaggugaaggggcugaccaagggcgggcccgggcacgaggagcccauccccauguccaccuacggcuggaaccucgugcggcugcagagcggggucgacguguucuucacgccgcccgagaagugcgacacccugcucugcgacaucggcgagagcucccccaaccccaccaucgaggccgggcgcacccugcgggugcugaaccucgucgagaacuggcugaacaacaacacccaguucugcaucaaggugcugaacccguacaugcccagcgugaucgagaagauggaggcccuccagcgcaaguacggcggcgcccugguccggaacccccugucccgcaacagcacgcacgagauguacuggguguccaacgcgaccgggaacaucgugagcuccgucaacaugaucagccggaugcugaucaaccgcuucaccaugaagcacaagaaggccaccuacgagccggacguggaccucggcuccgggacgcggaacaucggcaucgagagcgagauccccaaccuggacaucaucgggaagcgcaucgagaagaucaagcaggagcacgagaccuccuggcacuacgaccaggaccaccccuacaagaccugggccuaccacggcagcuacgagaccaagcagacgggcuccgccagcuccauggugaacggggucgugcgccugcucaccaagcccugggacguggucccgauggugacccagauggccaugaccgacacgacccccuucggccagcagcggguguucaaggagaaggucgacacccgcacccaggagcccaaggaggggacgaagaagcugaugaagaucaccgcggaguggcuguggaaggagcucggcaagaagaagacgccccggaugugcacccgcgaggaguucacgcggaaggugcgcagcaacgccgcccugggcgccaucuucaccgacgagaacaaguggaaguccgcccgggaggcgguggaggacgggcgcuucugggagcuggucgaccgggagcgcaaccuccaccuggagggcaagugcgagaccugcguguacaacaugauggggaagcgggagaagaagcugggcgaguucgggaaggccaagggcagccgcgccaucugguacauguggcucggcgcccgguuccuggaguucgaggcgcugggguuccucaacgaggaccacugguucucccgcggcaacagccugagcgggguggagggcgaggggcugcaccggcucggcuacauccugcgcgacgucggcaagaaggagggcggcgccauguacgccgacgacaccgccgggugggacacgcggaucacccuggaggaccucaagaacgaggagauggugaccaaccacaugaagggcgagcacaagaagcuggccgaggcgaucuucaagcugaccuaccagaacaaggucgugcgcgugcagcggccgacgccccgcgggaccgucauggacaucaucucccggcgcgaccagcgcggcagcggccagguggggaccuacggccucaacaccuucacgaacauggaggcccagcugauccggcagauggagggggagggcaucuucaaguccauccagcaccugaccgccaccgaggagaucgccgugcagaacuggcucgcccgcgucggccgggagcgccugagccggauggcgaucuccggggacgacugcguggugaagcccaucgacgaccgcuucgccagcgcccugaccgcccucaacgacaugggcaagguccggaaggacauccagcagugggagcccucccgcggguggaacgacuggacccaggucccguucugcagccaccacuuccacgagcuggugaugaaggacggccggguccugguggugcccugccgcaaccaggacgagcucaucgggcgggcccgcaucucccagggcgcgggcuggagccugaaggagaccgccugccuggggaaguccuacgcccagauguggacccucauguacuuccaccggcgcgaccugcggcuggccgccaacgcgaucugcagcgccgugccgccccacugggugccgaccucccgcaccacguggagcauccacgccaagcacgaguggaugaccaccgaggacaugcucgccguguggaaccgggucuggauccaggagaaccccuggauggaggacaagacccccguggaguccugggaggaggugcccuaccugggcaagcgcgaggaccaguggugcgggagccugaucggccucacgucccgggcgaccugggccaagaacauccagaccgccaucaaccagguccgcagccugaucgggaacgaggaguacaccgacuacaugccgagcaugaagcgcuuccggcgcgaggaggaggaggccggcgugcugugguga

SEQ ID NO: 9243 - RNA, 9876 nt, Artificial Sequence
  derived and/or modified CDS sequence (opt1) from DENV-2__FJ744744__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugaagauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacauccgcgggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgucgggcugcugcuccggaagcugaccagcaaggagcugaugauggccacgaucggcaucgcccuccugucccagagcaccauccccgagaccauccuggagcucaccgacgcccuggcgcuggggaugauggugcucaagaucgugcgcaacauggagaaguaccagcuggccgucacgaucauggccaucuccugcgugccgaacgccgugauccugcagaacgccuggaaggucagcugcaccauccucgcgguggucuccgugagcccccugcugcucaccuccagccagcagaaggccgacuggaucccccuggcccugaccaucaagggccucaaccccacggccaucuuccugaccacccugucccggaccagcaagaagcgcuccuggccgcucaacgaggcgaucauggccgugggcauggucagcauccuggccuccagccugcucaagaacgacauccccaugacggggccccugguggccggcgggcugcucaccgugugcuacguccugaccggccggagcgccgaccuggagcucgagcgcgcggccgacgugaagugggaggaccaggccgagaucuccgggagcucccccauccugagcaucaccaucuccgaggacggcagcauguccaucaagaacgaggaggaggagcagacgcugaccauccucauccggaccggccugcuggugaucagcggggucuucccgguguccauccccaucaccgccgccgcgugguaccucugggaggugaagaagcagcgcgccggcguccugugggacgugcccagcccgccgcccguggagaaggccgagcuggaggacggggccuaccggaucaagcagcgcggcauccucggguacucccagaucggcgccggcgucuacaaggaggggaccuuccacacgauguggcacgugacccggggcgcggugcugaugcaccgcgggaagcggaucgagcccagcugggccgacgucaagaaggaccugaucuccuacggcgggggcuggaagcucgagggcgaguggaaggagggggaggagguccaggugcuggcccuggagcccggcaagaacccccgcgccguccagaccaagcccgggaucuucaagaccaacacgggcaccaucggggccgugagccucgacuucucccccggcaccagcggcucccccaucguggaccggaaggggaaggucgugggccuguacgggaacggcguggucacccgcagcggcgcguacguguccgccaucgcccagacggagaaguccaucgaggacaaccccgagaucgaggacgacaucuuccggaagaagcgccugaccaucauggaccuccaccccggggccggcaagaccaagcgguaccugcccgcgaucgugcgcgaggccaucaagcgggggcugcgcacccugauccucgccccgacgcgcgucguggccgccgagauggaggaggcgcugcggggccugcccauccgcuaccagacccccgccaucaagaccgagcacaccgggcgggagaucguggaccucaugugccacgccacguucaccaugcgccugcugagccccguccgggugccgaacuacaaccucaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggucaccgacuucaagggcaagaccgugugguucgugccguccaucaaggccgggaacgacaucgccgccugccugcggaagaacggcaagaaggucauccagcugagccgcaagacguucgacuccgaguacgugaagacccgggcgaacgacugggacuucguggucaccaccgacaucagcgagaugggcgccaacuucaaggccgagcgcgugaucgacccccggcgcugcaugaagcccgugauccucacggacggggaggagcgggucauccuggccggccccaugccggugacccacuccagcgccgcgcagcgccgggggcgcaucggccgcaaccccaagaacgagaacgaccaguacaucuacaugggggagccccuggagaacgacgagaacugcgcccacuggaaggaggccaagaugcuccuggacaacaucaacacccccgagggcaucaucccguccauguucgagcccgagcgggagaagguggacgccaucgacggcgaguaccgccugcgcggggaggcccgcaagaccuucgucgaccucaugcggcgcggcgaccugcccguguggcuggcguacaagguggccgccgaggggaucaacuacgccgaccggaaguggugcuucgacggcaucaagaacaaccagauccucgaggagaacauggaggucgagaucuggacgaaggagggggagcgcaagaagcugaagccgcgguggcuggacgcccgcaucuacagcgacccccucgcgcugaaggaguucaaggaguucgccgccggccggaagucccugacccucaaccugaucaccgagaugggccgccugcccaccuucaugacgcagaaggcccggaacgcgcucgacaaccuggccgugcugcacaccgccgaggccgggggccgcgccuacaaccacgcgcucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcccagauccagccgcacuggaucgccgcguccaucauccuggaguucuuccucaucgugcugcugauccccgagcccgagaagcagcggacgccccaggacaaccagcucaccuacguggucaucgccauccugaccgugguggccgccaccauggccaacgagaugggcuuccuggagaagacgaagaaggaccucgggcugggcagcaucaccacccaggagagcgaguccaacauccuggacaucgaccuccgcccggcgagcgccuggacccuguacgccgucgccacgaccuucgugacccccaugcugcggcacuccaucgagaacagcuccgugaacgucagccucaccgccaucgcgaaccaggccacggugcugaugggccuggggaagggcuggccccucuccaagauggacaucggggugccccugcuggccaucggcugcuacagccaggucaacccgaucacccucaccgccgcgcugcugcuccugguggcccacuacgccaucaucgggcccggccugcaggccaaggccacccgcgaggcgcagaagcgggccgccgccggcaucaugaagaaccccacgguggacgggaucaccgucaucgaccucgagcccaucccguacgaccccaaguucgagaagcagcugggccaggugaugcugcucauccugugcgugacccagguccugaugaugcgcaccacgugggcccucugcgaggcgcugacccuggccaccgggcccaucuccacccucugggagggcaaccccgggcgguucuggaacacgaccaucgccgugagcauggccaacaucuuccgcggcuccuaccuggccggcgcggggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggagguggaccggacccuggccaaggaggggaucaagcgcggcgagacggaccaccacgccgucagccggggguccgcgaagcugcgcugguucguggagcggaacauggugaccccggagggcaaggucguggaccucggcugcgggcgcggcggguggagcuacuacugcggcgggcugaagaacgugcgggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggagagcucccccaaccccaccaucgaggccggccggacccugcgcgugcugaaccucguggagaacuggcugaacaacaacacccaguucugcaucaagguccugaacccguacaugcccagcgugaucgagaagauggaggcccuccagcggaaguacggcggggcccuggugcgcaacccccugucccggaacagcacgcacgagauguacugggucuccaacgccagcggcaacaucguguccagcgugaacaugaucucccgcaugcugaucaaccgguucaccaugaagcacaagaaggcgaccuacgagccggacgucgaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccugcucacgaagcccugggacguggugccgauggucacccagauggccaugaccgacaccacgcccuucgggcagcagcgcguguucaaggagaagguggacacccggacccaggagcccaaggagggcaccaagaagcugaugaagaucacggccgaguggcuguggaaggagcucggcaagaagaagacgccccgcaugugcacccgggaggaguucacccgcaagguccgguccaacgcggcccugggggccaucuucacggacgagaacaaguggaaguccgcccgcgaggccguggaggacucccgguucugggagcugguggaccgcgagcggaaccuccaccuggagggcaagugcgagaccugcgucuacaacaugauggggaagcgcgagaagaagcugggcgaguucgggaaggcgaagggcagccgggccaucugguacauguggcucggcgcccgcuuccuggaguucgaggcccugggguuccucaacgaggaccacugguucagccggggcaacucccugagcgggguggagggcgaggggcugcaccgccucggcuacauccugcgggacgucggcaagaaggagggcggcgcgauguacgccgacgacaccgccgggugggacacccgcaucacgcuggaggaccucaagaacgaggagauggugaccaaccacaugaagggcgagcacaagaagcuggccgaggccaucuucaagcugaccuaccagaacaaggugguccgggugcagcgcccgacgccccgggggacggugauggacaucaucucccgccgggaccagcgcggcagcggccaggucgggaccuacggccucaacaccuucaccaacauggaggcgcagcugauccgccagauggagggggagggcaucuucaaguccauccagcaccugacggccaccgaggagaucgccgugcagaacuggcucgcccgggugggccgcgagcggcugagccgcauggccaucuccggggacgacugcgucgugaagcccaucgacgaccgguucgcgagcgcccugaccgcccucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucgggcgcgcccggaucucccagggcgccggcuggagccugaaggagacggcgugccuggggaaguccuacgcccagauguggacccucauguacuuccaccgccgggaccugcgccuggccgccaacgccaucugcagcgcggugccgccccacugggucccgaccucccggaccaccuggagcauccacgccaagcacgaguggaugacgaccgaggacaugcucgccguguggaaccgcguguggauccaggagaaccccuggauggaggacaagacccccgucgaguccugggaggaggugcccuaccugggcaagcgggaggaccaguggugcgggagccugaucggccucaccagccgcgccacgugggcgaagaacauccagaccgccaucaaccaggugcggucccugaucgggaacgaggaguacaccgacuacaugccgagcaugaagcgcuuccgccgggaggaggaggaggccggcguccugugguga

SEQ ID NO: 9244 - RNA, 9876 nt, Artificial Sequence
  derived and/or modified CDS sequence (opt1) from DENV-2__GQ868646__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgaaguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggacaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccuccugcuggaggagaugcuccgcacccggaucggcacgaagcacgcgauccugcugguggccgugagcuucgucacccucaucaccgggaacauguccuuccgcgaccugggccgcgugauggugauggucggggccaccaugacggacgacaucggcaugggcgugaccuaccuggcccuccuggccgcguucaaggugcggcccaccuucgccgccgggcugcuccugcgcaagcugaccagcaaggagcucaugauggccacgaucggcaucgcccugcugucccagagcaccauccccgagaccauccucgagcugaccgacgcgcuggcccucgggaugaugguccugaagaucgugcggaacauggagaaguaccagcuggccgugacggucauggccaucuccugcgugccgaacgccgugauccuccagaacgcguggaaggucagcugcaccauccuggccgccguguccgucagcccccugcuccugaccuccagccagcagaaggccgacuggaucccccuggcgcucaccaucaagggccugaaccccacggccaucuuccugaccacccucucccgcaccagcaagaagcgguccuggccgcugaacgaggccaucauggccgugggcauggugagcauccuggccuccagccuccugaagaacgacauccccaugacggggccccuggucgcgggcgggcuccugaccgugugcuacgugcugaccggccgcagcgccgaccucgagcuggagcgggccgccgacgucaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcgggguguucccggucuccauccccaucaccgcggccgccugguaccugugggaggugaagaagcagcgggccggcgugcugugggacguccccagcccgccgcccguggagaaggccgagcucgaggacggggcguaccgcaucaagcagcggggcauccugggguacucccagaucggcgccggcguguacaaggaggggaccuuccacacgauguggcacgucacccgcggcgccgugcugaugcaccgggggaagcgcaucgagcccagcugggccgacgugaagaaggaccucaucuccuacggcgggggcuggaagcuggagggcgaguggaaggagggggaggagguccaggugcuggcccucgagcccggcaagaacccccgggcggugcagaccaagcccgggaucuucaagaccaacacgggcaccaucggggccgucagccuggacuucucccccggcaccagcggcucccccaucguggaccgcaaggggaagguggucggccuguacgggaacggcguggugacccggagcggcgccuacgucuccgccaucgcgcagacggagaaguccaucgaggacaaccccgagaucgaggacgacaucuuccgcaagaagcggcucaccaucauggaccugcaccccggggccggcaagaccaagcgcuaccugcccgccaucgugcgggaggccaucaagcgcgggcugcgcacccucauccuggccccgacgcggguggucgcggccgagauggaggaggcccugcgcggccuccccauccgguaccagaccaccgccaucaagaccgagcacacggggcgcgagaucguggaccugaugugccacgccaccuucaccaugcggcugcucagccccgugcgcguccccaacuacaaccugaucaucauggacgaggcgcacuucaccgacccggccuccaucgccgcccggggcuacaucagcacgcgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggucugguucgugcccuccaucaaggccgggaacgacaucgcggccugccugcgcaagaacggcaagaaggugauccagcucagccggaagaccuucgacuccgaguacgucaagacccgcgccaacgacugggacuucguggugaccacggacaucagcgagaugggcgccaacuucaaggccgagcgggucaucgacccgcgccggugcaugaagcccgugauccugaccgacggggaggagcgcgugauccuggcgggccccaugcccgucacccacuccagcgccgcccagcggcgcgggcgcaucggccggaacccgaagaacgagaacgaccaguacaucuacaugggggagccccucgagaacgacgaggacugcgcccacuggaaggaggccaagaugcugcuggacaacaucaacacccccgagggcaucauccccuccauguucgagccggagcgcgagaagguggacgcgaucgacggcgaguaccggcuccgcggggaggcccggaagacguucguggaccugaugcgccggggcgaccugcccgucuggcucgccuacaagguggccgccgaggggaucaacuacgcggaccgcaaguggugcuucgacggcaucaagaacaaccagauccuggaggagaacauggagguggagaucuggaccaaggagggggagcggaagaagcugaagccccgcuggcucgacgcccggaucuacagcgacccgcuggcccugaaggaguucaaggaguucgccgcgggccgcaagucccucacccugaaccugaucaccgagaugggccggcuccccacguucaugacccagaaggcccgcaacgcccuggacaaccuggccguccuccacaccgccgaggccgggggccgggccuacaaccacgcccugagcgagcugcccgagacccucgagacgcugcugcuccugacccugcucgccaccgugaccgggggcaucuuccuguuccugauguccggcaaggggaucggcaagaugacccucgggaugugcugcaucaucacggccagcauccugcugugguacgcgcagauccagccccacuggaucgccgccuccaucauccucgaguucuuccugaucguccugcucaucccggagcccgagaagcagcgcacgccccaggacaaccagcugaccuacguggugaucgccauccugaccgucguggccgcgacgauggccaacgagaugggcuuccucgagaagaccaagaaggaccuggggcugggcagcaucaccacccaggagagcgaguccaacauccucgacaucgaccugcggcccgccagcgccuggacgcuguacgccguggcgaccaccuucgucaccccgaugcuccgccacuccaucgagaacagcuccgugaacgugagccugacggccaucgccaaccaggccaccguccugaugggccucgggaagggcuggccccuguccaagauggacaucggggugccccugcucgcgaucggcugcuacagccaggugaaccccaucacccugaccgccgcccugcuccugcuggucgcccacuacgccaucaucgggccgggccuccaggcgaaggccacgcgggaggcccagaagcgcgccgccgcgggcaucaugaagaaccccaccguggacgggaucaccgugaucgaccuggagcccauccccuacgacccgaaguucgagaagcagcugggccaggucaugcuccugauccugugcgugacccaggugcucaugaugcggacgaccugggcccugugcgaggcccugacccucgccaccgggcccaucuccacgcugugggagggcaaccccgggcgcuucuggaacaccaccaucgccgucagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcucaacgcccugggcaagagcgaguuccagaucuacaagaaguccggcauccaggagguggaccgcacgcuggcgaaggaggggaucaagcggggcgagaccgaccaccacgccgugagccgcggguccgccaagcuccggugguucgucgagcgcaacauggugacccccgagggcaagguggucgaccugggcugcgggcggggcggguggagcuacuacugcggcgggcugaagaacgugcgcgaggugaagggccucaccaagggcgggccgggccacgaggagcccauccccauguccacguacggguggaaccugguccggcugcagagcggcguggacguguucuucacgccgcccgagaagugcgacacccuccugugcgacaucggggagagcucccccaaccccaccaucgaggccggccgcacccugcggguccucaaccugguggagaacuggcugaacaacaacacgcaguucugcaucaaggugcucaaccccuacaugcccagcgucaucgagaagauggaggcccugcagcgcaaguacggcggggcgcuggugcggaacccccugucccgcaacagcacccacgagauguacuggguguccaacgccaccggcaacaucgucagcuccgugaacaugaucagccggaugcucaucaaccgcuucaccaugaagcacaagaaggccacguacgagcccgacguggaccugggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcgccuccugaccaagcccugggacgucgugcccauggugacccagauggcgaugacggacaccaccccguucgggcagcagcgggucuucaaggagaagguggacacccgcacgcaggagcccaaggagggcaccaagaagcugaugaagaucaccgccgaguggcucuggaaggagcugggcaaggagaagacgccccggaugugcacgcgcgaggaguucacccggaaggugcgcagcaacgccgcccugggggccaucuucaccgacgagaacaaguggaaguccgcgcgggaggccgucgaggacggccgcuucugggagcucguggaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcgucgagggggagggccuccaccggcugggcuacauccugcgcgacguggggaagaaggagggcggggccauguacgccgacgacacggccggcugggacacccggaucacccucgaggaccugaagaacgaggagauggucaccaaccacaugaagggggagcacaagaagcuggcggaggccaucuucaagcucacguaccagaacaagguggugcgcguccagcggcccaccccgcgcggcaccgugauggacaucaucucccggcgcgaccagcgcggcagcgggcaggucggcaccuacgggcugaacacguucaccaacauggaggcccagcugauccggcagauggagggcgagggcaucuucaaguccauccagcaccucaccgccaccgaggagaucgccguccagaacuggcuggcgcgcguggggcgggagcgccugagccggauggccaucuccggcgacgacugcguggucaagcccaucgacgaccgcuucgccagcgcccucacggcccugaacgacauggggaaggugcggaaggacauccagcagugggagcccucccgcggcuggaacgacuggacccaggugcccuucugcagccaccacuuccacgagcuggucaugaaggacgggcgggugcucguggucccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccgugcccucccacugggugcccaccagccgcacgaccugguccauccacgccaagcacgaguggaugaccaccgaggacaugcuggcggucuggaaccggguguggauccaggagaaccccuggauggaggacaagacgccgguggagagcugggaggagguccccuaccuggggaagcgcgaggaccaguggugcggcucccucaucgggcugaccagccgggccaccugggccaagaacauccagaccgccaucaaccaggugcgcagccugaucggcaacgaggaguacacggacuacaugcccuccaugaagcgcuuccggcgcgaggaggaggaggccggcgugcucugguga

SEQ ID NO: 9245 - RNA, 9876 nt, Artificial Sequence
  derived and/or modified CDS sequence (opt1) from DENV-2__FJ906961__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccaccccggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagccccacaaccagaccuuccugaucgacgggccggagaccgccgagugccccaacacgaaccgcgccuggaacucccuggaggucgaggacuacggcuucgggguguucaccaccaacaucuggcucaagcugcgggagaagcaggagguguucugcgacagcaagcugauguccgccgccaucaaggacaaccgcgcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggccggugagccagcacaacuaccggcccggcuaccacacgcagaccgcggggcccuggcaccucggcaagcuggagauggacuucgaccugugcgaggggaccaccgugguggucacggaggacugcggcaaccgcggccccucccuccggaccaccaccgccagcgggaagcugaucacggaguggugcugccgcagcugcacccugccgccccuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccggaucggcacgaagcacgcgauccuccugguggccguguccuucgucacccugaucaccgggaacaugagcuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccuccaaggagcugaugauggccacgaucggcaucgcccuccugagccaguccaccaucccggagaccauccuggagcucaccgacgcgcuggcccuggggaugaugguccucaagaucgugcggaacauggagaaguaccagcuggccgugacgaucauggccaucagcugcguccccaacgccgugauccugcagaacgcguggaagguguccugcaccauccucgccgccgucagcgugagcccccugcugcucaccagcucccagcagaaggccgacuggaucccccuggcgcugaccaucaagggccucaacccgacggccaucuuccugaccacccugagccgcaccuccaagaagcggagcuggccccucaacgaggccaucauggccgucggcaugguguccauccuggccagcucccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucagcggguccagcccgauccuguccaucaccaucagcgaggacggcuccaugagcaucaagaacgaggaggaggagcagacgcugaccauccucauccgcaccggccugcuggucaucuccgggguguuccccgugagcauccccaucaccgcggccgccugguaccucugggaggucaagaagcagcgggccggcgugcugugggacgugcccuccccgccgcccgucgagaaggccgagcuggaggacggggcguaccgcaucaagcagcggggcauccucggguacagccagaucggcgccggcguguacaaggaggggaccuuccacacgauguggcacgugacccgcggcgccguccugaugcaccgggggaagcgcaucgagccguccugggccgacgugaagaaggaccugaucagcuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugucccucgacuucagcccgggcaccuccggcagccccaucgucgaccgcaaggggaagguggugggccuguacgggaacggcgucgugacccgguccggcgccuacgugagcgccaucgcgcagacggagaaguccaucgaggacaaccccgagaucgaggacgacaucuuccgcaagaagcggcugaccaucauggaccuccaccccggggccggcaagaccaagcgcuaccugccggccaucguccgggaggccaucaagcgcgggcugcgcacccugauccucgcccccacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugccgaacuacaaccucaucaucauggacgaggcgcacuucaccgaccccgccagcaucgccgcccggggcuacaucuccacgcgcgucgagaugggcgaggccgcggggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggccgggaacgacaucgcggccugccugcgcaagaacggcaagaaggugauccagcugucccggaagaccuucgacagcgaguacgugaagacccgcgccaacgacugggacuucgucgugaccacggacaucuccgagaugggcgccaacuucaaggccgagcgggugaucgacccccgccggugcaugaagcccgucauccucaccgacggggaggagcgcgugauccuggcgggccccaugccggugacccacagcuccgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccacguucaugacccagaaggcccgcaacgcccucgacaaccuggccgugcugcacaccgccgaggccgggggccgggccuacaaccacgcccucuccgagcugcccgagacccuggagacgcuccugcugcucacccugcuggccaccgucaccgggggcaucuuccucuuccugaugagcggcaaggggaucggcaagaugacccuggggaugugcugcaucaucacggccuccauccuccugugguacgcgcagauccagccgcacuggaucgccgccagcaucauccuggaguucuuccucaucgugcugcugauccccgagcccgagaagcagcgcacgccccaggacaaccagcucaccuacgucgugaucgccauccugaccguggucgccgcgacgauggccaacgagaugggcuuccuggagaagaccaagaaggaccucgggcugggcuccaucaccacccaggagagcgagagcaacauccuggacaucgaccuccggccggccuccgccuggacgcuguacgccguggcgaccaccuucgugacccccaugcugcgccacagcaucgagaacuccagcgucaacgugucccucacggccaucgccaaccaggccaccgugcugaugggccuggggaagggcuggccccucagcaagauggacaucggggucccccugcuggcgaucggcugcuacucccaggugaacccgaucacccucaccgccgcccugcugcuccugguggcccacuacgccaucaucgggcccggccugcaggcgaaggccacgcgggaggcccagaagcgcgccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcggacgaccugggcccucugcgaggcccugacccuggccaccgggcccaucagcacgcucugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaucggcgagacccugggcgagaaguggaagucccggcugaacgcccucgggaaguccgaguuccagaucuacaagaaguccggcauccaggaggucgaccgcacgcuggcgaaggaggggaucaagcggggcgagaccgaccaccacgccgugucccgcgggagcgccaagcugcggugguucguggagcgcaacauggucaccccggagggcaaggugguggaccucggcugcgggcggggcgggugguccuacuacugcggcgggcugaagaacguccgcgaggugaagggccugaccaagggcgggcccggccacgaggagcccauccccaugagcacguacggguggaaccucgugcggcugcaguccggcgucgacguguucuucaccccgcccgagaagugcgacacccugcucugcgacaucggggagagcagccccaaccccaccaucgaggccggccgcacccugcgggugcugaaccucgucgagaacuggcugaacaacaacacgcaguucugcaucaaggugcugaacccguacaugcccuccgugaucgagaagauggaggcccuccagcgcaaguacggcggggcgcugguccggaacccccugagccgcaacuccacccacgagauguacugggugagcaacgccaccggcaacaucguguccagcgucaacaugaucucccggaugcugaucaaccgcuucaccaugaagcacaagaaggccacguacgagccggacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacguggucccgauggugacccagauggcgaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcuccaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcucccgcgccaucugguacauguggcucggggcgcgguuccuggaguucgaggcccugggcuuccucaacgaggaccacugguucagccgcgggaacucccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggccgacgccccgcggcaccgucauggacaucaucagccggcgcgaccagcgcggcuccgggcaggucggcaccuacgggcucaacacguucaccaacauggaggcccagcugauccggcagauggagggcgagggcaucuucaagagcauccagcaccugaccgccaccgaggagaucgccgugcagaacuggcucgcgcgcgucgggcgggagcgccugucccggauggccaucagcggcgacgacugcguggugaagcccaucgacgaccgcuucgccuccgcccugacggcccucaacgacauggggaagguccggaaggacauccagcagugggagcccagccgcggcuggaacgacuggacccaggugccguucugcucccaccacuuccacgagcuggugaugaaggacgggcggguccugguggugcccugccgcaaccaggacgagcucaucggccgggcgcgcaucagccagggcgccggguggucccugaaggagaccgccugccugggcaagagcuacgcccagauguggacccucauguacuuccaccggcgcgaccugcggcuggccgcgaacgccaucugcuccgccguccccagccacugggugcccaccucccgcacgaccuggagcauccacgccaagcacgaguggaugaccaccgaggacaugcucgcgguguggaaccgggucuggauccaggagaacccguggauggaggacaagacgcccguggaguccugggaggaggugcccuaccuggggaagcgcgaggaccaguggugcggcagccugaucgggcucaccucccgggccaccugggccaagaacauccagaccgccaucaaccagguccgcagccugaucggcaacgaggaguacacggacuacaugcccagcaugaagcgcuuccggcgcgaggaggaggaggccggcgugcugugguga

SEQ ID NO: 9246 - RNA, 9876 nt, Artificial Sequence
  derived and/or modified CDS sequence (opt1) from DENV-2__FJ906962__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgagaucaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccgucguggugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccggaucggcacgaagcacgcgauccuccuggucgccgugagcuucgugacccugaucaccgggaacauguccuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaacauccuggagcucaccgacgcgcuggcccuggggaugauggugcucaagaucguccggaacauggagaaguaccagcuggccgugaccaucauggccaucuccugcgugccgaacgccgucauccugcagaacgcguggaaggugagcugcacgauccucgccgccguguccgucagcccccugcugcucaccuccagccagcagaaggccgacuggaucccccuggcgcugaccaucaagggccucaaccccaccgccaucuuccugacgacccugucccgcaccagcaagaagcgguccuggccgcucaacgaggccaucauggccgugggcauggucagcauccuggccuccagccugcucaagaacgacauccccaugaccgggccccugguggcgggcgggcugcucacggugugcuacguccugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacccugacgauccucauccgcaccggccugcuggugaucagcggggucuucccgguguccauccccaucaccgcggccgccugguaccucugggaggugaagaagcagcgggccggcguccugugggacgugcccagcccgccgcccguggagaaggccgagcuggaggacggggcguaccgcaucaagcagcggggcauccucggguacucccagaucggcgccggcgucuacaaggaggggaccuuccacaccauguggcacgugacgcgcggcgccgugcugaugcaccgggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggcgguccagaccaagcccgggaucuucaagaccaacaccggcacgaucggggccgugagccucgacuucucccccggcaccagcggcucccccaucguggaccgcaaggggaaggucgugggccuguacgggaacggcguggucacccggagcggcgccuacguguccgccaucgcgcagaccgagaaguccaucgaggacaaccccgagaucgaggacgacaucuuccgcaagaagcggcugacgaucauggaccuccaccccggggccggcaagaccaagcgcuaccugcccgccaucgugcgggaggccaucaagcgcgggcugcgcacccugauccucgccccgacccgggucguggcggccgagauggaggaggcccugcgcggccugcccauccgguaccagacgaccgccaucaagaccgagcacaccgggcgcgagaucguggaccucaugugccacgccacguucaccaugcggcugcugagccccguccgcgugcccaacuacaaccucaucaucauggacgaggcgcacuucaccgacccggccuccaucgccgcccggggcuacaucagcacccgcguggagaugggcgaggccgcggggaucuucaugacggccacgccgcccggcucccgggaccccuucccgcagagcaacgcccccaucauggacgaggagcgcgagauccccgagcgguccuggaacagcgggcacgagugggucaccgacuucaagggcaagaccgugugguucgugcccuccaucaaggccgggaacgacaucgcggccugccugcgcaagaacggcaagaaggucauccagcugagccggaagacguucgacuccgaguacgugaagacccgcgccaacgacugggacuucguggucaccaccgacaucagcgagaugggcgccaacuucaaggccgagcgggugaucgacccgcgccggugcaugaagcccgugauccucacggacggggaggagcgcgucauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaagguggacgcgaucgacggcgaguaccggcugcgcggggaggcccggaagaccuucgucgaccucaugcgccggggcgaccugcccguguggcuggccuacaagguggccgccgaggggaucaacuacgcggaccgcaaguggugcuucgacggcaucaagaacaaccagauccucgaggagaacauggaggucgagaucuggacgaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcgcagauccagccccacuggaucgccgccuccaucauccuggaguucuuccucaucguccugcugaucccggagcccgagaagcagcgcacgccccaggacaaccagcucaccuacguggucaucgccauccugaccgugguggccgcgaccauggccaacgagaugggcuuccuggagaagacgaagaaggaccucgggcugggcagcaucaccacccaggagagcgaguccaacauccuggacaucgaccuccggcccgccagcgccuggacccuguacgccgucgcgacgaccuucgugaccccgaugcugcgccacuccaucgagaacagcuccgugaacgucagccucaccgccaucgccaaccaggccacggugcugaugggccuggggaagggcuggccccucuccaagauggacaucggggugccccugcuggcgaucggcugcuacagccaggucaaccccaucacccucaccgccgcccugcugcuccugguggcccacuacgccaucaucgggccgggccugcaggcgaaggccacccgggaggcccagaagcgcgccgccgcgggcaucaugaagaaccccacgguggacgggaucaccgucaucgaccucgagcccauccccuacgacccgaaguucgagaagcagcugggccaggugaugcugcucauccugugcgugacccagguccugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggagguggaccgcacccuggcgaaggaggggaucaagcggggcgagacggaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggccgggccacgaggagcccauccccauguccaccuacggguggaaccucgugcggcugcagagcggcguggacgucuucuucacgcccccggagaagugcgacacccugcucugcgacaucggggagagcucccccaaccccaccaucgaggccggccgcacccugcgggugcugaaccucguggagaacuggcugaacaacaacacccaguucugcaucaagguccugaaccccuacaugccgagcgugaucgagaagauggaggcccuccagcgcaaguacggcggggcgcuggugcggaacccccugucccgcaacagcacgcacgagauguacugggucuccaacgccaccggcaacaucgugagcuccgugaacaugaucagccggaugcugaucaaccgcuucaccaugaagcacaagaaggccaccuacgagcccgacgucgaccucggguccggcacgcggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcucaccaagcccugggacguggugcccauggucacccagauggcgaugaccgacacgaccccguucgggcagcagcggguguucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaagguccgcagcaacgccgcccugggggccaucuucaccgacgagaacaaguggaaguccgcgcgggaggccguggaggacggccgcuucugggagcugguggaccgggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacguggggaagaaggagggcggggccauguacgccgacgacaccgccggcugggacacgcggaucacccuggaggaccucaagaacgaggagauggucaccaaccacaugaagggggagcacaagaagcuggcggaggccaucuucaagcugaccuaccagaacaaggugguccgcgugcagcggcccacgccgcgcggcaccgugauggacaucaucucccggcgcgaccagcgcggcagcgggcaggucggcaccuacgggcucaacaccuucacgaacaucgaggcccagcugauccggcagauggagggcgagggcaucuucaaguccauccagcaccugaccgccaccgaggagaucgccgugcagaacuggcucgcgcgcguggggcgggagcgccugagccggauggccaucuccggcgacgacugcgucgugaagcccaucgacgaccgcuucgccagcgcccugaccgcccucaacgacauggggaaggugcggaaggacauccagcagugggagcccucccgcggcuggaacgacuggacgcagguccccuucugcagccaccacuuccacgagcuggugaugaaggacgggcgggugcuggucgugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugcccucccacuggguccccaccagccgcaccacgugguccauccacgccaagcacgaguggaugaccaccgaggacaugcucgcgguguggaaccggguguggauccaggagaaccccuggauggaggacaagaccccggucgagagcugggaggaggugcccuaccuggggaagcgcgaggaccaguggugcggcucccugaucgggcucacgagccgggccaccugggccaagaacauccagaccgccaucaaccaggugcgcagccugaucggcaacgaggaguacaccgacuacaugcccuccaugaagcgcuuccggcgcgaggaggaggaggccggcguccugugguga

SEQ ID NO: 9247 - RNA, 9876 nt, Artificial Sequence
  derived and/or modified CDS sequence (opt1) from DENV-2__FJ850053__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccaccccggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagccccacaaccagaccuuccugaucgacgggccggagaccgccgagugccccaacacgaaccgcgccuggaacucccuggaggucgaggacuacggcuucgggguguucaccaccaacaucuggcucaagcugcgggagaagcaggacguguucugcgacagcaagcugauguccgccgccaucaaggacaaccgcgcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggccggugagccagcacaacuaccggcccggcuaccacacgcagaccgcggggcccuggcaccucggcaagcuggagauggacuucgaccugugcgaggggaccaccgugguggucacggaggacugcggcaaccgcggccccucccuccggaccaccaccgccagcgggaagcugaucacggaguggugcugccgcagcugcacccugccgccccuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccggaucggcacgaagcacgcgauccuccugguggccguguccuucgucacccugaucaccgggaacaugagcuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccuccaaggagcugaugauggccacgaucggcaucgcccuccugagccaguccaccaucccggagaccauccuggagcucaccgacgcgcuggcccuggggaugaugguccucaagaucgugcggaacauggagaaguaccagcuggccgugacgaucauggccaucagcugcguccccaacgccgugauccugcagaacgcguggaagguguccugcaccauccucgccgccgucagcgugagcccccugcugcucaccagcucccagcagaaggccgacuggaucccccuggcgcugaccaucaagggccucaacccgacggccaucuuccugaccacccugagccgcaccuccaagaagcggagcuggccccucaacgaggccaucauggccgucggcaugguguccauccuggccagcucccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucagcggguccagcccgauccuguccaucaccaucagcgaggacggcuccaugagcaucaagaacgaggaggaggagcagacgcugaccauccucauccgcaccggccugcuggucaucuccgggguguuccccgugagcauccccaucaccgcggccgccugguaccucugggaggucaagaagcagcgggccggcgugcugugggacgugcccuccccgccgcccgucgagaaggccgagcuggaggacggggcguaccgcaucaagcagcggggcauccucggguacagccagaucggcgccggcguguacaaggaggggaccuuccacacgauguggcacgugacccgcggcgccguccugaugcaccgggggaagcgcaucgagccguccugggccgacgugaagaaggaccugaucagcuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugucccucgacuucagcccgggcaccuccggcagccccaucgucgaccgcaaggggaagguggugggccuguacgggaacggcgucgugacccgguccggcgccuacgugagcgccaucgcgcagacggagaaguccaucgaggacaaccccgagaucgaggacgacaucuuccgcaagaagcggcugaccaucauggaccuccaccccggggccggcaagaccaagcgcuaccugccggccaucguccgggaggccaucaagcgcgggcugcgcacccugauccucgcccccacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugccgaacuacaaccucaucaucauggacgaggcgcacuucaccgaccccgccagcaucgccgcccggggcuacaucuccacgcgcgucgagaugggcgaggccgcggggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggccgggaacgacaucgcggccugccugcgcaagaacggcaagaaggugauccagcugucccggaagaccuucgacagcgaguacgugaagacccgcgccaacgacugggacuucgucgugaccacggacaucuccgagaugggcgccaacuucaaggccgagcgggugaucgacccccgccggugcaugaagcccgucauccucaccgacggggaggagcgcgugauccuggcgggccccaugccggugacccacagcuccgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccacguucaugacccagaaggcccgcaacgcccucgacaaccuggccgugcugcacaccgccgaggccgggggccgggccuacaaccacgcccucuccgagcugcccgagacccuggagacgcuccugcugcucacccugcuggccaccgucaccgggggcaucuuccucuuccugaugagcggcaaggggaucggcaagaugacccuggggaugugcugcaucaucacggccuccauccuccugugguacgcgcagauccagccgcacuggaucgccgccagcaucauccuggaguucuuccucaucgugcugcugauccccgagcccgagaagcagcgcacgccccaggacaaccagcucaccuacgucgugaucgccauccugaccguggucgccgcgacgauggccaacgagaugggcuuccuggagaagaccaagaaggaccucgggcugggcuccaucaccacccaggagagcgagagcaacauccuggacaucgaccuccggccggccuccgccuggacgcuguacgccguggcgaccaccuucgugacccccaugcugcgccacagcaucgagaacuccagcgucaacgugucccucacggccaucgccaaccaggccaccgugcugaugggccuggggaagggcuggccccucagcaagauggacaucggggucccccugcuggcgaucggcugcuacucccaggugaacccgaucacccucaccgccgcccugcugcuccugguggcccacuacgccaucaucgggcccggccugcaggcgaaggccacgcgggaggcccagaagcgcgccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcggacgaccugggcccucugcgaggcccugacccuggccaccgggcccaucagcacgcucugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaucggcgagacccugggcgagaaguggaagucccggcugaacgcccucgggaaguccgaguuccagaucuacaagaaguccggcauccaggaggucgaccgcacgcuggcgaaggaggggaucaagcggggcgagaccgaccaccacgccgugucccgcgggagcgccaagcugcggugguucguggagcgcaacauggucaccccggagggcaaggugguggaccucggcugcgggcggggcgggugguccuacuacugcggcgggcugaagaacguccgcgaggugaagggccugaccaagggcgggcccggccacgaggagcccauccccaugagcacguacggguggaaccucgugcggcugcaguccggcgucgacguguucuucaccccgcccgagaagugcgacacccugcucugcgacaucggggagagcagccccaaccccaccaucgaggccggccgcacccugcgggugcugaaccucgucgagaacuggcugaacaacaacacgcaguucugcaucaaggugcugaacccguacaugcccuccgugaucgagaagauggaggcccuccagcgcaaguacggcggggcgcugguccggaacccccugagccgcaacuccacccacgagauguacugggugagcaacgccaccggcaacaucguguccagcgucaacaugaucucccggaugcugaucaaccgcuucaccaugaagcacaagaaggccacguacgagccggacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacguggucccgauggugacccagauggcgaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcuccaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcucccgcgccaucugguacauguggcucggggcgcgguuccuggaguucgaggcccugggcuuccucaacgaggaccacugguucagccgcgggaacucccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggccgacgccccgcggcaccgucauggacaucaucagccggcgcgaccagcgcggcuccgggcaggucggcaccuacgggcucaacacguucaccaacauggaggcccagcugauccggcagauggagggcgagggcaucuucaagagcauccagcaccugaccgccaccgaggagaucgccgugcagaacuggcucgcgcgcgucgggcgggagcgccugucccggauggccaucagcggcgacgacugcguggugaagcccaucgacgaccgcuucgccuccgcccugacggcccucaacgacauggggaagguccggaaggacauccagcagugggagcccagccgcggcuggaacgacuggacccaggugccguucugcucccaccacuuccacgagcuggugaugaaggacgggcggguccugguggugcccugccgcaaccaggacgagcucaucggccgggcgcgcaucagccagggcgccggguggucccugaaggagaccgccugccugggcaagagcuacgcccagauguggacccucauguacuuccaccggcgcgaccugcggcuggccgcgaacgccaucugcuccgccguccccagccacugggugcccaccucccgcacgaccuggagcauccacgccaagcacgaguggaugaccaccgaggacaugcucgcgguguggaaccgggucuggauccaggagaacccguggauggaggacaagacgcccguggaguccugggaggaggugcccuaccuggggaagcgcgaggaccaguggugcggcagccugaucgggcucaccucccgggccaccugggccaagaacauccagaccgccaucaaccagguccgcagccugaucggcaacgaggaguacacggacuacaugcccagcaugaagcgcuuccggcgcgaggaggaggaggccggcgugcugugguga

SEQ ID NO: 9248 - RNA, 9876 nt, Artificial Sequence
  derived and/or modified CDS sequence (opt1) from DENV-2__JN819420__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagcgcgccagcuucaucgaggugaaguccugccacuggcccaagagccacacccugugguccaacggcguccuggagagcgagaugaucauccccaagaacuucgccgggcccgugucccagcacaacuaccggccgggcuaccacacgcagaccgcggggcccuggcaccucggcaagcuggagauggacuucgacuucugcgaggggaccaccguggucgugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggugaacagccuggucaccgccgggcacggccagaucgacaacuucucccucggcgugcuggggauggcccuguuccucgaggagaugcugcgcacccggaucggcacgaagcacgcgauccugcucguggccgucagcuucgugacccugaucaccgggaacauguccuuccgcgaccugggccgcgugauggucauggugggggccaccaugacggacgacaucggcaugggcgugaccuaccucgcccugcuggccgcguucaagguccggcccaccuucgccgccgggcuccugcugcgcaagcucaccagcaaggagcugaugauggccacgaucggcaucgcccugcucucccagagcaccauccccgagaccauccuggagcugaccgacgcgcucgcccuggggaugauggugcugaagaucgugcggaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccgugggcauggugagcauccucgccuccagccugcugaagaacgacauccccaugacggggccccucgucgcgggcgggcugcugaccgugugcuacgugcucaccggccgcagcgccgaccuggagcuggagcgggccgccgacgucaagugggaggaccaggccgagaucuccgggagcucccccauccucagcaucaccaucuccgaggacggcagcauguccaucaagaacgaggaggaggagcagacgcugaccauccugauccgcaccggccuccuggugaucagcgggguguucccggucuccauccccaucaccgcggccgccugguaccugugggaggugaagaagcagcgggccggcgugcucugggacguccccagcccgccgcccguggagaaggccgagcuggaggacggggcguaccgcaucaagcagcggggcauccugggguacucccagaucggcgccggcguguacaaggaggggaccuuccacacgauguggcacgucacccgcggcgccgugcucaugcaccgggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggaucuucaagaccaacacgggcaccaucggggccgucagccuggacuucucccccggcaccagcggcucccccaucguggaccgcaaggggaagguggucggccucuacgggaacggcguggugacccggagcggcgccuacgucuccgccaucgcgcagacggagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcgcacccugauccuggccccgacgcggguggucgcggccgagauggaggaggcccuccgcggccugcccauccgguaccagacccccgccaucaagaccgagcacaccgggcgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccuccgcaagaacggcaagaaggugauccagcugagccggaagacguucgacuccgaguacgucaagacccgcgccaacgacugggacuucguggugaccaccgacaucagcgagaugggcgccaacuucaaggccgagcgggucaucgacccccgccggugcaugaagcccgugauccugacggacuccgaggagcgcgugauccucgcggggcccaugccggucacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgaggggaucaucccgagcauguucgagcccgagcgcgagaagguggacgcgaucgacggcgaguaccggcugcgcggcgaggcccggaagaccuucguggaccugaugcgccgcggggaccuccccgucuggcuggccuacaagguggccgccgagggcaucaacuacgcggaccgcaaguggugcuucgacgggaucaagaacaaccagauccuggaggagaacauggagguggagaucuggacgaaggagggcgagcggaagaagcucaagccgcgcuggcuggacgcccggaucuacuccgacccccuggcccucaaggaguucaaggaguucgccgcggggcgcaagagccugacccugaaccucaucaccgagaugggccggcugcccaccuucaugacgcagaaggcccgcaacgcccuggacaaccucgccguccugcacaccgccgaggcgggcgggcgggccuacaaccacgcccuguccgagcuccccgagacccuggagacccugcuccugcugacgcuccuggccaccgugaccggcgggaucuuccuguuccucaugagcggcaagggcaucgggaagaugacccugggcaugugcugcaucaucaccgccuccauccugcucugguacgcgcagauccagccgcacuggaucgccgccagcaucauccuggaguucuuccugaucguccuccugauccccgagcccgagaagcagcgcacgccccaggacaaccagcugaccuacguggugaucgccauccucaccgucguggccgcgaccauggccaacgagaugggguuccuggagaagacgaagaaggaccugggccucgggagcaucaccacccaggaguccgagagcaacauccuggacaucgaccugcggccggccuccgccuggacccucuacgccguggcgacgaccuucgucacccccaugcugcgccacagcaucgagaacuccagcgugaacgugucccugaccgccaucgccaaccaggccacgguccucaugggccugggcaagggguggccccugagcaagauggacaucggcgugccccuccuggcgauggggugcuacucccaguucaagccgaucacccugaccgccgcccuccugcugcucguggcccacuacgccaucaucggccccgggcugcaggcgaaggccacccgggaggcccagaagcgcgccgccgcgggcaucaugaagaaccccacggucgacggcaucaccgugaucgaccuggagcccaucccguacgaccccaaguucgagaagcagcucgggcaggucaugcugcugauccucugcgucacccaggugcugaugaugcggaccacgugggcccugugcgaggcccucacccuggccaccggccccaucagcacccugugggaggggaaccccggccgcuucuggaacacgaccaucgccguguccauggcgaacaucuuccgcgggagcuaccucgccggcgccggccugcuguucuccaucaugaagaacaccaccagcacgcggcgcgggaccggcaacaucggggagacccucggcgagaaguggaagucccggcugaacgcccugggcaagagcgaguuccagaucuacaagaaguccgggauccaggaggucgaccgcacccucgcgaaggagggcaucaagcgcggggagacggaccaccacgccgugagccgcggcuccgccaagcugcggugguucguggagcgcaacauggucaccccggaggggaaggugguggaccugggcugcggccgcgggggcuggagcuacuacugcgggggccucaagaacguccgcgaggugaaggggcugaccaagggcggccccgggcacgaggagcccauccccaugagcaccuacggcuggaaccuggugcggcuccaguccggggucgacguguucuucacgccgcccgagaagugcgacacccugcugugcgacaucggcgagagcucccccaaccccaccaucgaggccgggcgcacccuccgggugcugaaccuggucgagaacuggcucaacaacaacacccaguucugcaucaaggugcugaacccguacaugcccagcgugaucgagaagauggaggcccugcagcgccaguacggcggcgcgcucguccggaacccccugucccgcaacagcacgcacgagauguacuggguguccaacgccaccgggaacaucgugagcuccgucaacaugaucagccggaugcugaucaaccgcuucaccaugaagcacaagaaggccaccuacgagccggacguggaccugggcuccgggacgcggaacaucggcaucgagagcgagauccccaaccucgacaucaucgggaagcgcaucgagaagaucaagcaggagcacgagaucuccuggcacuacgaccaggaccaccccuacaagaccugggccuaccacggcagcuacgagaccaagcagaccggcuccgccagcuccauggugaacggggucgugcgccugcugacgaagcccugggacguggucccgauggugacccagauggcgaugaccgacaccacgcccuucggccagcagcggguguucaaggagaaggucgacacccgcacccaggagcccaaggaggggaccaagaagcucaugaagaucacggccgaguggcuguggaaggagcugggcaagaagaagacgccccggaugugcacccgcgaggaguucaccaagaaggugcggagcaacgccgcccucggcgccaucuucacggacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucagccggggcaacucccucagcgggguggagggcgaggggcugcaccgccugggcuacauccuccgggacgucggcaagaaggagggcggcgccauguacgccgacgacaccgccgggugggacacccgcaucacgcuggaggaccugaagaacgaggagauggugaccaaccacaugaagggcgagcacaagaagcucgcggaggccaucuucaagcugaccuaccagaacaaggucgugcgggugcagcgcccgacgccccgggggacggucauggacaucaucucccgccgggaccagcgcggcagcggccagguggggaccuacggccugaacaccuucaccaacauggaggcccagcucauccgccagauggagggggagggcaucuucaaguccauccagcaccugacggccaccgaggagaucgccgugcagaacuggcuggcgcgggucggccgcgagcggcucagccgcauggccaucuccggggacgacugcguggugaagcccaucgacgaccgguucgccagcgcccugaccgcccugaacgacaugggcaagguccgcaaggacauccagcagugggagcccucccggggguggaacgacuggacccaggugccguucugcagccaccacuuccacgagcucgugaugaaggacggccgcguccugguggugcccugccggaaccaggacgagcugaucgggcgcgcgcggaucucccagggcgccggcuggagccucaaggagacggccugccuggggaaguccuacgcccagauguggacccugauguacuuccaccgccgggaccuccgccuggccgcgaacgccaucugcagcgccguccccucccacugggugcccaccagccggaccaccugguccauccacgccaagcacgaguggaugacgaccgaggacaugcuggcgguguggaaccgcgucuggauccaggagaacccguggauggaggacaagacccccguggagagcugggaggaggugcccuaccucggcaagcgggaggaccaguggugcgggagccugaucggccugaccucccgcgccacgugggccaagaacauccagaccgccaucaaccagguccggagccucaucgggaacgaggaguacaccgacuacaugcccuccaugaagcgcuuccgccgggaggaggaggaggccggcgugcugugguga

SEQ ID NO: 9249 - RNA, 9876 nt, Artificial Sequence
  derived and/or modified CDS sequence (opt1) from DENV-2__FJ850118__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccggguacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagacccccgccaucaagaccgagcacaccgggcgcgagaucgucgaccucaugugccacgccacguucaccaugcggcugcugagccccgugcgcgugccgaacuacaaccucaucaucauggacgaggcgcacuucaccgaccccgccuccaucgccgcccggggcuacaucagcacccgcgucgagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccccgccggugcaugaagcccgucauccucacggacggggaggagcgcgugauccuggcgggccccaugccggugacccacuccagcgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccggccggccagcgccuggacccuguacgccguggcgacgaccuucgugacccccaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgggaggcccagaagcgcgccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggaggucgaccgcacccuggcgaaggaggggaucaagcggggcgagacggaccaccacgccgugagccgcggguccgccaagcugcggugguucguggagcgcaacauggucaccccggagggcaaggugguggaccucggcugcgggcggggcggguggagcuacuacugcggcgggcugaagaacguccgcgaggugaagggccugaccaagggcgggcccggccacgaggagcccauccccauguccaccuacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacccaguucugcaucaaggugcugaacccguacaugcccagcgugaucgagaagauggaggcccuccagcgcaaguacggcggggcgcugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagccggacguggaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacguggucccgauggugacccagauggcgaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgccggcugggacacgcggaucacccuggaggaccucaagaacgaggagauggugaccaaccacaugaagggggagcacaagaagcuggcggaggccaucuucaagcugaccuaccagaacaaggucgugcgcgugcagcggccgacgccccgcggcaccgucauggacaucaucucccggcgcgaccagcgcggcagcgggcaggucggcaccuacgggcucaacaccuucacgaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugaccgcccucaacgacauggggaagguccggaaggacauccagcagugggagcccucccgcggcuggaacgacuggacccaggucccguucugcagccaccacuuccacgagcuggugaugaaggacgggcggguccugguggugcccugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugccgccccacugggugccgaccucccgcaccacguggagcauccacgccaagcacgaguggaugaccaccgaggacaugcucgcgguguggaaccgggucuggauccaggagaaccccuggauggaggacaagacccccguggaguccugggaggaggugcccuaccuggggaagcgcgaggaccaguggugcggcagccugaucgggcucacgucccgggccaccugggccaagaacauccagaccgccaucaaccagguccgcagccugaucggcaacgaggaguacaccgacuacaugccgagcaugaagcgcuuccggcgcgaggaggaggaggccggcgugcugugguga

SEQ ID NO: 9250 - RNA, 9876 nt, Artificial Sequence
  derived and/or modified CDS sequence (opt1) from DENV-2__JN819416__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccggcgggcgcgccuacaaccacgcccucagcgagcugcccgagacccuggagacccuccugcugcucacgcugcuggccaccgucaccggcgggaucuuccucuuccugauguccgggaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgugacccccaugcugcggcacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggaggucgaccggacccuggcgaaggaggggaucaagcgcggcgagacggaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggaggcccuccagcggaaguacggcggggcgcugguccgcaacccccugucccggaacagcacgcacgagauguacuggguguccaacgccaccggcaacaucgugagcuccgucaacaugaucagccgcaugcugaucaaccgguucaccaugaagcacaagaaggccaccuacgagccggacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacguggucccgauggugacccagauggcgaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcggagcaacgccgcccugggggccaucuucaccgacgagaacaaguggaaguccgcgcgcgaggccguggaggacagccgguucugggagcuggucgaccgcgagcggaaccuccaccuggagggcaagugcgagaccugcguguacaacaugauggggaagcgcgagaagaagcugggcgaguucgggaaggccaagggcucccgggccaucugguacauguggcucggcgcgcgcuuccuggaguucgaggcccugggguuccucaacgaggaccacugguucagccggggcaacagccuguccgggguggagggcgaggggcugcaccgccucggcuacauccugcgggacgucggcaagaaggagggcggcgccauguacgccgacgacaccgccgggugggacacgcgcaucacccuggaggaccucaagaacgaggagauggugaccaaccacaugaagggcgagcacaagaagcuggcggaggccaucuucaagcugaccuaccagaacaaggucgugcgggugcagcgcccgacgccccgggggaccgucauggacaucaucagccgccgggaccagcgcggcuccggccagguggggaccuacggccucaacaccuucacgaacauggaggcccagcugauccgccagauggagggggagggcaucuucaagagcauccagcaccugaccgccaccgaggagaucgccgugcagaacuggcucgcgcgggucggccgcgagcggcugucccgcauggccaucagcggggacgacugcguggugaagcccaucgacgaccgguucgccuccgcccugaccgcccucaacgacaugggcaagguccgcaaggacauccagcagugggagcccagccggggguggaacgacuggacccaggucccguucugcucccaccacuuccacgagcuggugaugaaggacggccgcguccugguggugcccugccggaaccaggacgagcucaucgggcgcgcgcggaucagccagggcgccggcuggucccugaaggagaccgccugccugggcaagagcuacgcccagauguggacccucauguacuuccaccgccgggaccugcgccuggccgcgaacgccaucugcuccgccgugccgccccacugggugccgaccagccggaccacgugguccauccacgccaagcacgaguggaugaccaccgaggacaugcucgcgguguggaaccgcgucuggauccaggagaaccccuggauggaggacaagacccccguggagagcugggaggaggugcccuaccugggcaagcgggaggaccaguggugcgggucccugaucggccucacgagccgcgccaccugggccaagaacauccagaccgccaucaaccagguccggagccugaucgggaacgaggaguacaccgacuacaugccguccaugaagcgcuuccgccgggaggaggaggaggccggcgugcugugguga

SEQ ID NO: 9251 - RNA, 9876 nt, Artificial Sequence
  derived and/or modified CDS sequence (opt1) from DENV-2__FJ850119__SS-prME
accgcgggcgugaucgugaugcugauccccaccgccauggcguuccaccucaccacccgcaacggggagccccacaugaucgugggccggcaggagaaggggaagucccugcuguucaagaccgaggacggcaucaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgaccugugcgaggggaccaccgucguggugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcaucggcacgaagcacgcgauccuccuggucgccgugagcuucgugacccugaucaccgggaacauguccuuccgggaccucggccgcgucauggugauggugggggccaccaugacggacgacaucggcaugggcgucaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucguccgcaacauggagaaguaccagcuggccgugacgaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgugggcauggucagcauccuggccuccagccugcucaagaacgacauccccaugacggggccccugguggcgggcgggcugcucaccgugugcuacguccugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggugaucagcggggucuucccgguguccauccccaucaccgcggccgccugguaccucugggaggugaagaagcagcgcgccggcguccugugggacgugcccagcccgccgcccguggagaaggccgagcuggaggacggggcguaccggaucaagcagcgcggcauccucggguacucccagaucggcgccggcgucuacaaggaggggaccuuccacacgauguggcacgugacccggggcgccgugcugaugcaccgcgggaagcggaucgagcccagcugggccgacgucaagaaggaccugaucuccuacggcgggggcuggaagcucgagggcgaguggaaggagggggaggagguccaggugcuggcccuggagcccggcaagaacccccgcgcgguccagaccaagcccgggaucuucaagaccaacacgggcaccaucggggccgugagccucgacuucucccccggcaccagcggcucccccaucguggaccggaaggggaaggucgugggccuguacgggaacggcguggucacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgccccgacgcgcgucguggcggccgagauggaggaggcccugcggggccugcccauccgcuaccagacccccgccaucaagaccgagcacaccgggcgggagaucguggaccucaugugccacgccacguucaccaugcgccugcugagccccguccgggugccgaacuacaaccucaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgcggccugccugcggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccucacggacggggaggagcgggucauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgcgaucgacggcgaguaccgccugcgcggggaggcccgcaagaccuucgucgaccucaugcggcgcggcgaccugcccguguggcuggccuacaagguggccgccgaggggaucaacuacgcggaccggaaguggugcuucgacggcaucaagaacaaccagauccucgaggagaacauggaggucgagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggucaucgccauccugaccgugguggccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccgucgcgacgaccuucgugacccccaugcugcggcacuccaucgagaacagcuccgugaacgucagccucaccgccaucgccaaccaggccacggugcugaugggccuggggaagggcuggccccucuccaagauggacaucggggugccccugcuggcgaucggcugcuacagccaggucaacccgaucacccucaccgccgcccugcugcuccugguggcccacuacgccaucaucgggcccggccugcaggcgaaggccacccgcgaggcccagaagcgggccgccgcgggcaucaugaagaaccccacgguggacgggaucaccgucaucgaccucgagcccaucccguacgaccccaaguucgagaagcagcugggccaggugaugcugcucauccugugcgugacccagguccugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggagguggaccggacccuggcgaaggaggggaucaagcgcggcgagacggaccaccacgccgucagccggggguccgccaagcugcgcugguucguggagcggaacauggugaccccggagggcaaggucguggaccucggcugcgggcgcggcggguggagcuacuacugcggcgggcugaagaacgugcgggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggagagcucccccaaccccaccaucgaggccggccggacccugcgcgugcugaaccucguggagaacuggcugaacaacaacacccaguucugcaucaagguccugaacccguacaugcccagcgugaucgagaagauggaggcccuccagcggaaguacggcggggcgcuggugcgcaacccccugucccggaacagcacgcacgagauguacugggucuccaacgccaccggcaacaucgugagcuccgugaacaugaucagccgcaugcugaucaaccgguucaccaugaagcacaagaaggccaccuacgagccggacgucgaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcucaccaagcccugggacguggugccgauggucacccagauggcgaugaccgacacgacccccuucgggcagcagcgcguguucaaggagaagguggacacccggacccaggagcccaaggagggcacgaagaagcugaugaagaucaccgccgaguggcuguggaaggagcucggcaagaagaagacgccccgcaugugcacccgggaggaguucacgcgcaagguccggagcaacgccgcccugggggccaucuucaccgacgagaacaaguggaaguccgcgcgcgaggccguggaggacggccgguucugggagcugguggaccgcgagcggaaccuccaccuggaggggaagugcgagaccugcgucuacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacguggggaagaaggagggcggggccauguacgccgacgacaccgccggcugggacacgcgcaucacccuggaggaccucaagaacgaggagauggucaccaaccacaugaagggggagcacaagaagcuggcggaggccaucuucaagcugaccuaccagaacaaggugguccgggugcagcgcccgacgccccggggcaccgugauggacaucaucucccgccgggaccagcgcggcagcgggcaggucggcaccuacgggcucaacaccuucacgaacauggaggcccagcugauccgccagauggagggcgagggcaucuucaaguccauccagcaccugaccgccagcgaggagaccgccgugcagaacuggcucgcgcggguggggcgcgagcggcugucccgcauggccaucagcggcgacgacugcgucgugaagcccaucgacgaccgguucgccuccgcccugaccgcccucaacgacauggggaaggugcgcaaggacauccagcagugggagcccagccggggcuggaacgacuggacgcaggucccguucugcucccaccacuuccacgagcuggugaugaaggacgggcgcgugcuggucgugcccugccggaaccaggacgagcucaucggccgcgcgcggaucagccagggcgccggguggucccugaaggagaccgccugccugggcaagagcuacgcccagauguggacccucauguacuuccaccgccgggaccugcgccuggccgcgaacgccaucugcuccgccgugccgccccacugggucccgaccagccggaccacgugguccauccacgccaagcacgaguggaugaccaccgaggacaugcucgcgguguggaaccgcguguggauccaggagaaccccuggauggaggacaagacccccgucgagagcugggaggaggugcccuaccuggggaagcgggaggaccaguggugcggcucccugaucgggcucacgagccgcgccaccugggccaagaacauccagaccgccaucaaccaggugcggagccugaucggcaacgaggaguacaccgacuacaugccguccaugaagcgcuuccgccgggaggaggaggaggccggcguccugugguga

SEQ ID NO: 9252 - RNA, 9876 nt, Artificial Sequence
  derived and/or modified CDS sequence (opt1) from DENV-2__FJ850064__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgccacgaccaugcgcggcgccaagcggauggccauccugggggacaccgccugggacuucggcagccucgggggcgucuucaccuccaucgggaaggcgcuccaccagguguucggcgccaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggcgaugguccaggccgacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgcgaucaaggacaaccgggccguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgcggggcccgucucccagcacaacuaccgcccgggcuaccacacgcagaccgccgggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccuguuccuggaggagaugcugcggacccgcaucggcacgaagcacgccauccuccugguggccgugagcuucgucacccugaucaccgggaacauguccuuccgggaccucggccgcgugauggugauggucggggccaccaugacggacgacaucggcaugggcgugaccuaccuggcccugcucgcggccuucaaggugcgccccaccuucgccgccgggcugcugcuccggaagcugaccagcaaggagcugaugauggccacgaucggcaucgcgcuccugucccagagcaccauccccgagaccauccuggagcucaccgacgcccuggcccuggggaugaugguccucaagaucgugcgcaacauggagaaguaccagcuggccgugacgaucauggccaucuccugcgucccgaacgcggugauccugcagaacgccuggaaggugagcugcaccauccucgccgccgucuccgugagcccccugcugcucaccuccagccagcagaaggcggacuggaucccccuggcccugaccaucaagggccucaaccccacggccaucuuccugaccacccugucccggaccagcaagaagcgcuccuggccgcucaacgaggccaucauggccgucggcauggugagcauccuggcguccagccugcucaagaacgacauccccaugacggggccccugguggccggcgggcugcucaccgucugcuacgugcugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgccgccgccugguaccucugggaggucaagaagcagcgcgccggcgugcugugggacgugcccagcccgccgcccgucgagaaggcggagcuggaggacggggccuaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgcgaucgcccagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgcgccgacgcgcgugguggccgccgagauggaggaggcccugcggggccugcccauccgcuaccagacccccgccaucaagaccgagcacaccgggcgggagaucgucgaccucaugugccacgcgacguucaccaugcgccugcugagccccgugcgggugccgaacuacaaccucaucaucauggacgaggcccacuucaccgaccccgccuccaucgccgcccgcggcuacaucagcacccgggucgagaugggcgaggcggccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagacguucgacuccgaguacgugaagacccgggccaacgacugggacuucgucgugaccaccgacaucagcgagaugggcgccaacuucaaggcggagcgcgugaucgacccccggcgcugcaugaagcccgucauccucacggacggggaggagcgggugauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccaccuucaugacgcagaaggcccggaacgcccucgacaaccuggccgugcugcacaccgcggaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacgucgugaucgccauccugaccguggucgcggccaccauggccaacgagaugggcuuccuggagaagacgaagaaggaccucgggcugggcagcaucaccacccaggagagcgaguccaacauccuggacaucgaccuccgcccggccagcgccuggacccuguacgcgguggccacgaccuucgugacccccaugcugcggcacuccaucgagaacagcuccgucaacgugagccucaccgccaucgccaaccaggcgacggugcugaugggccuggggaagggcuggccccucuccaagauggacaucggggucccccugcuggccaucggcugcuacagccaggugaacccgaucacccucaccgccgcccugcugcuccugguggcccacuacgcgaucaucgggcccggccugcaggccaaggccacccgcgaggcccagaagcgggccgcggccggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgcggugagcauggccaacaucuuccgcggcuccuaccuggccggcgccgggcuccucuucagcaucaugaagaacaccaccaacacgcgccggggcaccgggaacaucggcgagacccugggcgagaaguggaagucccgccugaacgcgcucggcaagagcgaguuccagaucuacaagaaguccggcauccaggaggucgaccggacccuggccaaggaggggaucaagcgcggcgagacggaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggaggcgcuccagcggaaguacggcggggcccugguccgcaacccccugucccggaacagcacgcacgagauguacuggguguccaacgccaccggcaacaucgugagcuccgucaacaugaucagccgcaugcugaucaaccgguucaccaugaagcacaagaaggccaccuacgagccggacguggaccucggguccggcacgcgcaacaucgggaucgagagcgaggugcccaaccuggacaucaucggcaagcggaucgagaagaucaagcaggagcacgagaccuccuggcacuacgaccaggaccaccccuacaagaccugggccuaccacggcagcuacgagaccaagcagacgggguccgcgagcuccauggucaacggcguggugcgccugcucaccaagcccugggacgucgugccgauggugacccagauggccaugaccgacacgacccccuucgggcagcagcgcgucuucaaggagaagguggacacccggacccaggagcccaaggagggcacgaagaagcugaugaagaucaccgccgaguggcuguggaaggagcucggcaagaagaagacgccccgcaugugcacccgggaggaguucacgcgcaaggugcggagcaacgccgcccugggggcgaucuucaccgacgagaacaaguggaaguccgcccgcgaggccgucgaggacggccgguucugggagcugguggaccgcgagcggaaccuccaccuggaggggaagugcgagaccugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcgucgagggggagggccugcaccgccucggcuacauccugcgggacguggggaagaaggagggcggggccauguacgccgacgacaccgcgggcugggacacgcgcaucacccuggaggaccucaagaacgaggagauggucaccaaccacaugaagggggagcacaagaagcuggccgaggccaucuucaagcugaccuaccagaacaagguggugcggguccagcgcccgacgccccggggcaccgugauggacaucaucucccgccgggaccagcgcggcagcgggcaggucggcaccuacgggcucaacaccuucacgaacauggaggcccagcugauccgccagauggagggcgagggcaucuucaaguccauccagcaccugaccgccaccgaggagaucgcgguccagaacuggcucgcccggguggggcgcgagcggcugagccgcauggccaucuccggcgacgacugcguggucaagcccaucgacgaccgguucgccagcgcccugaccgcgcucaacgacauggggaaggugcgcaaggacauccagcagugggagcccucccggggcuggaacgacuggacccaggugccguucugcagccaccacuuccacgagcuggucaugaaggacgggcgcgugcuggugguccccugccggaaccaggacgagcucaucggccgcgcccggaucucccagggcgccggguggagccugaaggagaccgccugccugggcaaguccuacgcccagauguggacccucauguacuuccaccgccgggaccugcgccuggcggccaacgccaucugcagcgccgugccgccccacugggugccgaccucccggaccacguggagcauccacgcgaagcacgaguggaugaccaccgaggacaugcucgccgucuggaaccgcguguggauccaggagaaccccuggauggaggacaagacccccguggaguccugggaggagguccccuaccuggggaagcgggaggaccaguggugcggcagccugaucgggcucacgucccgcgccaccugggccaagaacauccagaccgccaucaaccaggugcggagccugaucggcaacgaggaguacaccgacuacaugccgagcaugaagcgcuuccgccgggaggaggaggaggcgggcgugcugugguga

SEQ ID NO: 9253 - RNA, 9876 nt, Artificial Sequence
  derived and/or modified CDS sequence (opt1) from DENV-2__FJ850065__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccaccauggccaagaacaagcccacccuggacuucgagcugaucaagaccgaggccaagcagcccgccacccuccgcaaguacugcacggaggccaagcugaccaacaccaccacggagucccggugccccacccagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacacgaucgucaucacgccccacagcggggaggagcacgccgugggcaacgacaccgggaagcacggcaaggagaucaagaucaccccgcaguccagcaucaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgcgaagaagcaggacgucgugguccucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacagccccgugaacaucgaggcggagccgcccuucggcgacuccuacaucaucaucgggguggagccgggccagcugaagcucaacugguucaagaaggggagcuccaucggccagauguucgagaccaccaugcgcggcgccaagcggauggccauccugggggacaccgccugggacuucggcagccucgggggcgucuucacguccaucgggaaggcccuccaccagguguucggcgcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcguggugagcuggaagaacaaggagcucaagugcggcuccgggaucuucaucaccgacaacguccacaccuggaccgagcaguacaaguuccagcccgagagccccagcaagcuggccuccgccauccagaaggcccacgaggagggcaucugcgggauccggagcgugacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacgcugugguccaacggcgugcuggagagcgagaugaucauccccaagaacuucgccgggcccgucucccagcacaacuaccgcccgggcuaccacacccagaccgcggggcccuggcaccucggcaagcuggagauggacuucgaccugugcgaggggaccacggugguggucaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacgcgcaucggcaccaagcacgcgauccuccugguggccgugagcuucgucacccugaucaccgggaacauguccuuccgggaccucggccgcgugauggugauggucggggccacgaugaccgacgacaucggcaugggcgugaccuaccuggcccugcucgccgcguucaaggugcgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugaugguccucaagaucgugcgcaacauggagaaguaccagcuggccgugaccaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugacgaucaagggccucaaccccaccgccaucuuccugaccacccugucccggacgagcaagaagcgcuccuggccgcucaacgaggccaucauggccgucggcauggugagcauccuggccuccagccugcucaagaacgacauccccaugaccgggccccugguggcgggcgggcugcucaccgucugcuacgugcugaccggccggagcgccgaccuggagcucgagcgcgccgccgacgugaagugggaggaccaggccgagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggacguuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagacgaacaccggcaccaucggggccgugagccucgacuucucccccggcaccagcggcucccccaucgucgaccggaaggggaagguggugggccuguacgggaacggcgucgugacgcgcagcggcgccuacguguccgccaucgcgcagaccgagaaguccaucgaggacaaccccgagaucgaggaggacaucuuccggaagaagcgccugaccaucauggaccuccaccccggggccggcaagaccaagcgguaccugcccgccaucguccgcgaggccaucaagcgggggcugcgcacgcugauccucgccccgacccgcgugguggcggccgagauggaggaggcccugcggggccugcccauccgcuaccagacccccgccaucaagaccgagcacacggggcgggagaucgucgaccucaugugccacgccaccuucaccaugcgccugcugagccccgugcgggugccgaacuacaaccucaucaucauggacgaggcgcacuucaccgaccccgccuccaucgccgcccgcggcuacaucagcacgcgggucgagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagacggugugguucgucccguccaucaaggccgggaacgacaucgcggccugccugcggaagaacggcaagaaggugauccagcugagccgcaagaccuucgacuccgaguacgugaagacccgggccaacgacugggacuucgucgugaccacggacaucagcgagaugggcgccaacuucaaggccgagcgcgugaucgacccccggcgcugcaugaagcccgucauccucaccgacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagacguucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccgugcugcacaccgccgaggccgggggccgcgccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccgcccggccagcgccuggacgcuguacgccguggcgaccaccuucgugacccccaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacgcgcgaggcccagaagcgggccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccacguacggguggaaccucgugcgccugcagagcggcgucgacguguucuucaccccgcccgagaagugcgacacccugcucugcgacaucggggagagcucccccaaccccaccaucgaggccggccggacccugcgcgugcugaaccucgucgagaacuggcugaacaacaacacgcaguucugcaucaaggugcugaacccguacaugcccagcgugaucgagaagauggaggcccuccagcggaagcacggcggggcgcugguccgcaacccccugucccggaacagcacccacgagauguacuggguguccaacgccaccggcaacaucgugagcuccgucaacaugaucagccgcaugcugaucaaccgguucaccaugaagcacaagaaggccacguacgagccggacguggaccucggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacguggucccgauggugacccagauggcgaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcggagcaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacacggccggcugggacacccgcaucacccuggaggaccucaagaacgaggagauggugaccaaccacaugaagggggagcacaagaagcuggcggaggccaucuucaagcugacguaccagaacaaggucgugcgggugcagcgcccgacgccccggggcaccgucauggacaucaucucccgccgggaccagcgcggcagcgggcaggucggcaccuacgggcucaacacguucaccaacauggaggcccagcugauccgccagauggagggcgagggcaucuucaaguccauccagcaccugaccgccaccgaggagaucgccgugcagaacuggcucgcgcgggucgggcgcgagcggcugagccgcauggccaucuccggcgacgacugcguggugaagcccaucgacgaccgguucgccagcgcccugacggcccucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccgugccgccccacugggugccgaccucccggacgaccuggagcauccacgccaagcacgaguggaugaccaccgaggacaugcucgcgguguggaaccgcgucuggauccaggagaaccccuggauggaggacaagacgcccguggaguccugggaggaggugcccuaccuggggaagcgggaggaccaguggugcggcagccugaucgggcucaccucccgcgccaccugggccaagaacauccagaccgccaucaaccagguccggagccugaucggcaacgaggaguacacggacuacaugccgagcaugaagcgcuuccgccgggaggaggaggaggccggcgugcugugguga

SEQ ID NO: 9254 - RNA, 9876 nt, Artificial Sequence
  derived and/or modified CDS sequence (opt1) from DENV-2__FJ873808__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaagauccgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucguccgcaacauggagaaguaccagcuggccgugacgaucauggccaucuccugcgugccgaacgccgucauccugcagaacgcguggaaggugagcugcgccauccucgccgccguguccgucagcccccugcugcucaccuccagcaagcagaaggcggacuggaucccccuggcccugaccaucaagggccucaaccccaccgccaucuuccugacgacccugucccggaccagcaagaagcgcuccuggccgcucaacgaggccgugauggccgucggcauggugagcauccuggcguccagccugcucaagaacgacauccccaugaccgggccccugguggccggcgggcugcucacggucugcuacgugcugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacccugacgauccucauccggaccggccugcuggucaucagcgggguguucccgguguccauccccaucaccgccgccgccugguaccucugggaggucaagaagcagcgcgccggcgugcugugggacgugcccagcccgccgcccgucgagaaggcggagcuggaggacggggccuaccggaucaagcagcgcggcauccucggguacucccagaucggcgccggcguguacaaggaggggaccuuccacaccauguggcacgugacgcggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccgggaucuucaagaccaacaccggcacgaucggggccgugagccucgacuucucccccggcaccagcggcucccccaucgucgaccggaaggggaagguggugggccuguacgggaacggcgucgugacccgcagcggcgccuacguguccgcgaucgcccagaccgagaaguccaucgaggacaaccccgagaucgaggacgacaucuuccggaagaagcgccugacgaucauggaccuccaccccggggccggcaagaccaagcgguaccugcccgccaucguccgcgaggccaucaagcgggggcugcgcacccugauccucgcgccgacccgcgugguggccgccgagauggaggaggcccugcggggccugcccauccgcuaccagacgcccgccaucaagaccgagcacaccgggcgggagaucgucgaccucaugugccacgcgaccuucacgaugcgccugcugagccccgugcgggugccgaacuacaaccucaucaucauggacgaggcccacuucaccgaccccgccuccaucgccgcccgcggcuacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagaccuucgacuccgaguacgugaagacgcgggccaacgacugggacuucgucgugaccaccgacaucagcgagaugggcgccaacuucaaggcggagcgcgugaucgacccccggcgcugcaugaagcccgucauccucaccgacggggaggagcgggugauccuggccggccccaugccggugacgcacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcauccgcaacaaccagauccucgaggagaacauggagguggagaucuggaccaaggagggggagcggaagaagcugaagccgcgcuggcuggacgcccggaucuacagcgacccccucgcccugaaggaguucaaggaguucgcggccggccgcaagucccugacgcucaaccugaucaccgagaugggcaagcugcccaccuucaugacccagaaggcccggaacgcccucgacaaccuggccgugcugcacacggcggaggccgggggccgcgccuacaaccacgcccucagcgagcugcccgagacccuggagacccuccugcugcucacccugcuggccacggucaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucacguacgucgugaucgccauccugaccguggucgcggccaccauggccaacgagaugggcuuccuggagaagaccaagaaggaccucgggcugggcagcaucacgacccaggagagcgaguccaacauccuggacaucgaccuccgcccggccagcgccuggacccuguacgcgguggccaccacguucgugacccccaugcugcggcacuccaucgagaacagcuccgucaacgugagccucaccgccaucgccaaccaggcgaccgugcugaugggccuggggaagggcuggccccucuccaagauggacaucggggucccccugcuggccaucggcugcuacagccaggugaacccgaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgagcccaucccguacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaaccccgggcgguucuggaacaccacgaucgcggugagcauggccaacaucuuccgcggcuccuaccuggccggcgccgggcuccuguucagcaucaugaagaacaccaccaacacccgccggggcacggggaacaucggcgagacccugggcgagaaguggaagucccgccugaacgcgcucggcaagagcgaguuccagaucuacaagaaguccggcauccaggaggucgaccggacccuggccaaggaggggaucaagcgcggcgagaccgaccaccacgccgugagccggggguccgccaagcugcgcugguucguggagcggaacauggucacgccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucaccccgcccgagaagugcgacacgcugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggaggcgcuccagcggaaguacggcggggcccugguccgcaacccccugucccggaacagcacccacgagauguacuggguguccaacgccacgggcaacaucgugagcuccgucaacaugaucagccgcaugcugaucaaccgguucaccaugaagcacaagaaggccaccuacgagccggacguggaccucggguccggcacccgcaacaucgggaucgagagcgagauccccaaccuggacaucaucggcaagcggaucgagaagaucaagcaggagcacgagacguccuggcacuacgaccaggaccaccccuacaagaccugggccuaccacggcagcuacgagaccaagcagaccggguccgcgagcuccauggugaacggcgucgugcgccugcucacgaagcccugggacguggucccgauggugacccagauggccaugaccgacaccacgcccuucgggcagcagcgcguguucaaggagaaggucgacacccggacccaggagcccaaggagggcaccaagaagcugaugaagaucacggccgaguggcuguggaaggagcucggcaagaagaagacgccccgcaugugcacccgggaggaguucacccgcaaggugcggagcaacgccgcccugggggcgaucuucacggacgagaacaaguggaaguccgcccgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacaccgcgggcugggacacccgcaucacgcuggaggaccucaagaacgaggagauggugaccaaccacaugaagggggagcacaagaagcuggccgaggccaucuucaagcugaccuaccagaacaaggucgugcgggugcagcgcccgacgccccggggcacggucauggacaucaucucccgccgggaccagcgcggcagcgggcaggucggcaccuacgggcucaacaccuucaccaacauggaggcccagcugauccgccagauggagggcgagggcaucuucaaguccauccagcaccugacggccaccgaggagaucgcggugcagaacuggcucgcccgggucgggcgcgagcggcugagccgcauggccaucuccggcgacgacugcguggugaagcccaucgacgaccgguucgccagcgcccugaccgcgcucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggcgccggguggagccugaaggagacggccugccugggcaaguccuacgcccagauguggacccucauguacuuccaccgccgggaccugcgccuggcggccaacgccaucugcagcgccgugccgccccacugggugccgaccucccggaccaccuggagcauccacgcgaagcacgaguggaugacgaccgaggacaugcucgccguguggaaccgcgucuggauccaggggaaccccuggauggaggacaagacccccguggaguccugggaggaggugcccuaccugggcaagcgggaggaccaguggugcgggagccugaucggccucaccucccgcgccacgugggccaagaacauccagaccgccaucaaccagguccggagccugaucggcaacgaggaguacaccgacuacaugccgagcaugaagcgcuuccgccgggaggaggaggaggcgggggugcugugguga

SEQ ID NO: 9255 - RNA, 9876 nt, Artificial Sequence
  derived and/or modified CDS sequence (opt1) from DENV-2__FJ850120__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcgugaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucaccgaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagacgaccaugcgcggcgccaagcggauggccauccugggggacaccgccugggacuucggcagccucggcgggguguucaccuccaucgggaaggcccuccaccagguguucggggcgaucuacggcgccgccuucagcggggucuccuggacgaugaagauccugaucggcgugaucaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucgggguguucaccaccaacaucuggcucaagcugcgggagaagcaggacgucuucugcgacuccaagcugaugagcgccgccaucaaggacaaccgcgcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccguggucgugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgucaccgccgggcacggccagaucgacaacuucucccugggcgugcuggggauggcccucuuccuggaggagaugcugcgcacccggaucggcacgaagcacgcgauccuccugguggccgucagcuucgugacccugaucaccgggaacauguccuuccgcgaccucggccgcgugauggucauggugggggccaccaugacggacgacaucggcaugggcgugaccuaccuggcccugcucgccgcguucaagguccggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugauggugcucaagaucgugcggaacauggagaaguaccagcuggccgucacgaucauggccaucuccugcgugccgaacgccgugauccugcagaacgcguggaaggucagcugcaccauccucgccgccguguccgucagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgugggcauggugagcauccuggccuccagccugcucaagaacgacauccccaugacggggccccuggucgcgggcgggcugcucaccgugugcuacgugcugaccggccgcagcgccgaccuggagcucgagcgggccgccgacgucaagugggaggaccaggccgagaucuccgggagcucccccauccugagcaucaccaucuccgaggacggcagcauguccaucaagaacgaggaggaggagcagacgcugaccauccucauccgcaccggccugcuggugaucagcgggguguucccggucuccauccccaucaccgcggccgccugguaccucugggaggugaagaagcagcgggccggcgugcugugggacguccccagcccgccgcccguggagaaggccaagcuggaggacggggcguaccgcaucaagcagcggggcauccucggguacucccagaucggcgccggcguguacaaggaggggaccuuccacacgauguggcacgucacccgcggcgccgugcugaugcaccgggggaagcgcaucgagcccagcugggccgacgugaagaaggaccugaucuccuacggcgggggcuggaagcucgagggcgaguggaaggagggggaggagguccaggugcuggcccuggagcccggcaagaacccccgggcggugcagaccaagcccgggaucuucaagaccaacacgggcaccaucggggccgucagccucgacuucucccccggcaccagcggcucccccaucguggaccgcaaggggaagguggucggccuguacgggaacggcguggugacccggagcggcgccuacgucuccgccaucgcgcagacggagaagaacaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcgcacccugauccucgccccgacgcggguggucgcggccgagauggaggaggcccugcgcggccugcccauccgguaccagacccccgccaucaagaccgagcacaccgggcgcgagaucguggaccucaugugccacgccacguucaccaugcggcugcugagccccgugcgcgucccgaacuacaaccucaucaucauggacgaggcgcacuucaccgaccccgccagcaucgccgcccggggcuacaucuccacccgcguggagaugggcgaggccgcggggaucuucaugacggccacgccgcccggcagccgggacccguucccccaguccaacgcccccaucauggacgaggagcgcgagauccccgagcggagcuggaacuccgggcacgagugggugaccgacuucaagggcaagaccgucugguucgugccgagcaucaaggccgggaacgacaucgcggccugccugcgcaagaacggcaagaaggugauccagcugucccggaagacguucgacagcgaguacgucaagacccgcgccaacgacugggacuucguggugaccaccgacaucuccgagaugggcgccaacuucaaggccgagcgggucaucgacccccgccggugcaugaagcccgugauccucacggacggggaggagcgcgugauccuggcgggccccaugccggucacccacagcuccgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccggaagaccuucguggaccucaugcgccggggcgaccugcccgucuggcuggccuacaagguggccgccgaggggaucaacuacgcggaccgcaaguggugcuucgacggcaucaagaacaaccagauccucgaggagaacauggagguggagaucuggacgaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccaccuucaugacgcagaaggcccgcaacgcccucgacaaccuggccguccugcacaccgccgaggccgggggccgggccuacaaccacgcccucuccgagcugcccgagacccuggagacccuccugcugcucacgcugcuggccaccgugaccgggggcaucuuccucuuccugaugagcggcaaggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucaccuacguggugaucgccauccugaccgucguggccgcgaccauggccaacgagaugggcuuccuggagaagacgaagaaggaccucgggcugggcuccaucaccacccaggagagcgagagcaacauccuggacaucgaccuccggccggccuccgccuggacccuguacgccguggcgacgaccuucgucacccccaugcugcgccacagcaucgagaacuccagcgugaacgugucccucaccgccaucgccaaccaggccacgguccugaugggccuggggaagggcuggccccucagcaagauggacaucggggugccccugcuggcgaucggcugcuacucccaggugaacccgaucacccucaccgccgcccugcugcuccuggucgcccacuacgccaucaucgggcccggccugcaggcgaaggccacccgggaggcccagaagcgcgccgccgcgggcaucaugaagaaccccacgguggacgggaucaccgugaucgaccucgagcccaucccguacgaccccaaguucgagaagcagcugggccaggucaugcugcucauccugugcgugacccaggugcugaugaugcggaccacgugggcccucugcgaggcccugacccuggccaccgggcccaucagcacccucugggagggcaaccccgggcgcuucuggaacacgaccaucgccgucuccauggcgaacaucuuccgcggcagcuaccuggccggcgccgggcuccuguucuccaucaugaagaacaccaccaacacgcggcgcggcaccgggagcaucggcgagacccugggcgagaaguggaagucccggcugaacgcccucggcaagagcgaguuccagaucuacaagaaguccggcauccaggagguggaccgcacccuggcgaaggaggggaucaagcggggcgagacggaccaccacgccgugagccgcggguccgccaagcugcggugguucgucgagcgcaacauggugaccccggagggcaagguggucgaccucggcugcgggcggggcggguggagcuacuacugcggcgggcugaagaacgugcgcgaggugaagggccugaccaagggcgggcccggccacgaggagcccauccccauguccaccuacggguggaaccucguccggcugcagagcggcguggacguguucuucacgccgcccgagaagugcgacacccugcucugcgacaucggggagagcucccccaaccccaccaucgaggccggccgcacccugcggguccugaaccucguggagaacuggcugaacaacaacacccaguucugcaucaaggugcugaacccguacaugcccagcgucaucgagaagauggaggcccuccagcgcaaguacggcggggcgcuggugcggaacccccugucccgcaacagcacgcacgagauguacuggguguccaacgccaccggcaacaucgucagcuccgugaacaugaucagccggaugcugaucaaccgcuucaccaugaagcacaagaaggccaccuacgagccggacguggaccucggguccggcacgcggaacaucgggaucgagaacgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcucaccaagcccugggacgucgugccgauggugacccagauggcgaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgccgcccugggggccaucuucaccgacgagaacaaguggaaguccgcgcgggaggccgucgaggacucccgcuucugggagcugguggaccgggagcgcaaccuccaccuggagggcaagugcgagaccugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcggcaacagccugagcggggucgagggcgaggggcugcaccggcucggcuacauccugcgcgacgugggcaagaaggagggcggcgccauguacgccgacgacaccgccgggugggacacgcggaucacccuggaggaccucaagaacgaggagauggucaccaaccacaugaagggcgagcacaagaagcuggcggaggccaucuucaagcugaccuaccagaacaagguggugcgcguccagcggccgacgccccgcgggaccgugauggacaucaucucccggcgcgaccagcgcggcagcggccagguggggaccuacggccucaacaccuucacgaacauggaggcccagcugauccggcagauggagggggagggcaucuucaaguccauccagcaccugaccgccaccgaggagaucgccguccagaacuggcucgcgcgcgugggccgggagcgccugagccggauggccaucuccggggacgacugcguggucaagcccaucgacgaccgcuucgccagcgcccugaccgcccucaacgacaugggcaaggugcggaaggacauccagcagugggagcccucccgcggguggaacgacuggacccaggucccguucugcagccaccacuuccacgagcuggucaugaaggacggccgggugcuggugguccccugccgcaaccaggacgagcucaucgggcgggcgcgcaucucccagggcgccggcuggagccugaaggagaccgccugccuggggaaguccuacgcccagauguggacccucauguacuuccaccggcgcgaccugcggcuggccgcgaacgccaucugcagcgccgugcccucccacugggugcccaccagccgcaccacgugguccauccacgccaagcacgaguggaugaccaccgaggacaugcucgcggucuggaaccggguguggauccaggagaacccguggauggaggacaagacccccguggagagcugggaggagguccccuaccugggcaagcgcgaggaccaguggugcgggucccugaucggccucacgagccgggccaccugggccaagaacauccagaccgccaucaaccaggugcgcagccugaucgggaacgaggaguacaccgacuacaugcccuccaugaagcgcuuccggcgcgaggaggaggaggccggcgugcugugguga

SEQ ID NO: 9256 - RNA, 9876 nt, Artificial Sequence
  derived and/or modified CDS sequence (opt1) from DENV-2__FJ850121__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgaccugugcgaggggaccaccgucguggugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcaucggcacgaagcacgucacccuccugguggcggugagcuucgucacccugaucaccgggaacauguccuuccgggaccucggccgcgugauggugauggucggggccacgaugaccgacgacaucggcaugggcgugaccuaccuggcccugcucgccgccuucaaggugcgccccaccuucgcggccgggcugcugcuccggaagcugacgagcaaggagcugaugauggccaccaucggcaucgcccuccugucccagagcaccauccccgagaccauccuggagcucacggacgcccuggcgcuggggaugaugguccucaagaucgugcgcaacauggagaaguaccagcuggccgugaccaucauggccaucuccugcgucccgaacgccgugauccugcagaacgccuggaaggugagcugcaccauccucgcggccgucuccgugagcccccugcugcucaccuccagccagcagaaggccgacuggaucccccuggcccugacgaucaagggccucaaccccaccgcgaucuuccugaccacccugucccggacgagcaagaagcgcuccuggccgcucaacgaggccaucauggccgucggcauggugagcauccuggccuccagccugcucaagaacgacauccccaugaccgggccccugguggccggcgggcugcucaccgucugcuacgugcugaccggccggagcgcggaccuggagcucgagcgcgccgccgacgugaagugggaggaccaggccgagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucaccgccgcggccugguaccucugggaggucaagaagcagcgcgccggcgugcugugggacgugcccagcccgccgcccgucgagaaggccgagcuggaggacggggccuaccggaucaagcagcgcggcauccucggguacucccagaucggcgcgggcguguacaaggaggggacguuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgccgugcagaccaagcccgggaucuucaagacgaacaccggcaccaucggggcggugagccucgacuucucccccggcaccagcggcucccccaucgucgaccggaaggggaagguggugggccuguacgggaacggcgucgugacgcgcagcggcgccuacguguccgccaucgcccagaccgagaaguccaucgaggacaaccccgagaucgaggacgacaucuuccggaagaagcgccugaccaucauggaccuccaccccggggcgggcaagaccaagcgguaccugcccgccaucguccgcgaggccaucaagcgggggcugcgcacgcugauccucgccccgacccgcgugguggccgcggagauggaggaggcccugcggggccugcccauccgcuaccagacccccgccaucaagaccgagcacacggggcgggagaucgucgaccucaugugccacgccaccuucaccaugcgccugcugagccccgugcgggugccgaacuacaaccucaucaucauggacgaggcccacuucaccgaccccgcguccaucgccgcccgcggcuacaucagcacgcgggucgagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugaccgacuucaagggcaagacggugugguucgucccguccaucaaggccgggaacgacaucgccgcgugccugcggaagaacggcaagaaggugauccagcugagccgcaagaccuucgacuccgaguacgugaagacccgggccaacgacugggacuucgucgugaccacggacaucagcgagaugggcgccaacuucaaggccgagcgcgugaucgacccccggcgcugcaugaagcccgucauccucaccgacggggaggagcgggugauccuggccggccccaugccggugacccacuccagcgcggcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgccaucgacggcgaguaccgccugcgcggggaggcgcgcaagacguucguggaccucaugcggcgcggcgaccugcccguguggcuggccuacaaggucgccgccgaggggaucaacuacgccgaccggaaguggugcuucgacggcaucaagaacaaccagauccucgaggagaacauggagguggagaucuggaccaaggagggggagcgcaagaagcugaagccgcgguggcuggacgcgcgcaucuacagcgacccccucgcccugaaggaguucaaggaguucgccgccggccggaagucccugacccucaaccugaucaccgagaugggccgccugcccacguucaugacccagaaggcgcggaacgcccucgacaaccuggccgugcugcacaccgccgaggccgggggccgcgcguacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucgggcugggcagcaucaccacccaggagagcgaguccaacauccuggacaucgaccuccgcccggccagcgccuggacgcuguacgccguggccaccaccuucgugacccccaugcugcggcacuccaucgagaacagcuccgucaacgugagccucacggcgaucgccaaccaggccaccgugcugaugggccuggggaagggcuggccccucuccaagauggacaucggggucccccugcuggccaucggcugcuacagccaggugaacccgaucacccucaccgcggcccugcugcuccugguggcccacuacgccaucaucgggcccggccugcaggccaaggcgacgcgcgaggcccagaagcgggccgccgccggcaucaugaagaaccccaccgucgacgggaucaccgugaucgaccucgagcccaucccguacgaccccaaguucgagaagcagcugggccaggugaugcugcucauccugugcgucacccaggugcugaugaugcgcacgaccugggcgcucugcgaggcccugacccuggccaccgggcccaucuccacgcucugggagggcaaccccgggcgguucuggaacaccaccaucgccgugagcauggccaacaucuuccgcggcuccuaccuggcgggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggccaaggaggggaucaagcgcggcgagaccgaccaccacgcggugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccacguacggguggaaccucgugcgccugcagagcggcgucgacguguucuucaccccgcccgagaagugcgacacccugcucugcgacaucggggagagcucccccaaccccaccaucgaggccggccggacccugcgcgugcugaaccucgucgagaacuggcugaacaacaacacgcaguucugcaucaaggugcugaacccguacaugcccagcgugaucgagaagauggaggcccuccagcggaaguacggcggggcccugguccgcaacccccugucccggaacagcacccacgagauguacuggguguccaacgcgaccggcaacaucgugagcuccgucaacaugaucagccgcaugcugaucaaccgguucaccaugaagcacaagaaggccacguacgagccggacguggaccucggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacguggucccgauggugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagacgccccgcaugugcacgcgggaggaguucacccgcaaggugcggagcaacgccgcccugggggccaucuucaccgacgagaacaaguggaaguccgcccgcgaggcgguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggggaacagccugagcggcguggagggggagggccugcaccgccucggcuacauccugcgggacgucgggaagaaggagggcggggccauguacgccgacgacacggccggcugggacacccgcaucacccuggaggaccucaagaacgaggagauggugaccaaccacaugaagggggagcacaagaagcuggccgaggcgaucuucaagcugacguaccagaacaaggucgugcgggugcagcgcccgacgccccggggcaccgucauggacaucaucucccgccgggaccagcgcggcagcgggcaggucggcaccuacgggcucaacacguucaccaacauggaggcccagcugauccgccagauggagggcgagggcaucuucaaguccauccagcaccugaccgccaccgaggagaucgccgugcagaacuggcucgcccgggucgggcgcgagcggcugagccgcauggcgaucuccggcgacgacugcguggugaagcccaucgacgaccgguucgccagcgcccugacggcccucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggcgcgggguggagccugaaggagaccgccugccugggcaaguccuacgcccagauguggacccucauguacuuccaccgccgggaccugcgccuggccgccaacgcgaucugcagcgccgugccgccccacugggugccgaccucccggacgaccuggagcauccacgccaagcacgaguggaugaccaccgaggacaugcucgccguguggaaccgcgucuggauccaggagaaccccuggauggaggacaagacgcccguggaguccugggaggaggugcccuaccuggggaagcgggaggaccaguggugcggcagccugaucgggcucaccucccgcgcgaccugggccaagaacauccagaccgccaucaaccagguccggagccugaucggcaacgaggaguacacggacuacaugccgagcaugaagcgcuuccgccgggaggaggaggaggccggcgugcugugguga

SEQ ID NO: 9257 - RNA, 9876 nt, Artificial Sequence
  derived and/or modified CDS sequence (opt1) from DENV-2__GQ199897__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucgugagcgggguguucccggucuccauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacucccagaucggcgccggcguguacaaggaggggaccuuccacacgauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagaccaagcccgggaucuucaagaccaacacgggcaccaucggggccgucagccucgacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgccccgacgcgcguggucgcggccgagauggaggaggcccugcggggccugcccauccgcuaccagacccccgccaucaagaccgagcacaccgggcgggagaucguggaccucaugugccacgccacguucaccaugcgccugcugagccccgugcgggucccgaacuacaaccucaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccucacggacggggaggagcgggugauccuggcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgcgaucgacggcgaguaccgccugcgcggggaggcccgcaagaccuucguggaccucaugcggcgcggcgaccugcccgucuggcuggccuacaagguggccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccguccugcacaccgccgaggccgggggccgcgccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgucacccccaugcugcggcacuccaucgagaacagcuccgugaacgugagccucaccgccaucgccaaccaggccacgguccugaugggccuggggaagggcuggccccucuccaagauggacaucggggugccccugcuggcgaucggcugcuacagccaggugaacccgaucacccucaccgccgcccugcugcuccuggucgcccacuacgccaucaucgggcccggccugcaggcgaaggccacccgcgaggcccagaagcgggccgccgcgggcaucaugaagaaccccacgguggacgggaucaccgugaucgaccucgagcccaucccguacgaccccaaguucgagaagcagcugggccaggucaugcugcucauccugugcgugacccaggugcugaugaugcgcaccacgugggcccucugcgaggcccugacccuggccaccgggcccaucuccacccucugggagggcaaccccgggcgguucuggaacacgaccaucgccgucagcauggcgaacaucuuccgcggcuccuaccuggccggcgccgggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggagguggaccggacccuggcgaaggaggggaucaagcgcggcgagacggaccaccacgccgugagccggggguccgccaagcugcgcugguucgucgagcggaacauggugaccccggagggcaagguggucgaccucggcugcgggcgcggcggguggagcuacuacugcggcgggcugaagaacgugcgggaggugaagggccugaccaagggcgggcccggccacgaggagcccauccccauguccaccuacggguggaaccucguccgccugcagagcggcguggacguguucuucacgccgcccgagaagugcgacacccugcucugcgacaucggggagagcucccccaaccccaccaucgaggccggccggacccugcgcguccugaaccucguggagaacuggcugaacaacaacacccaguucugcaucaaggugcugaacccguacaugcccagcgucaucgagaagauggaggcccuccagcggaaguacggcggggcgcuggugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagccggacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggucaacggcguggugcgccugcucaccaagcccugggacgucgugccgauggugacccagauggcgaugaccgacacgacccccuucgggcagcagcgcgucuucaaggagaagguggacacccggacccaggagcccaaggagggcacgaagaagcugaugaagaucaccgccgaguggcuguggaaggagcucggcaagaagaagacgccccgcaugugcacccgggaggaguucacgcgcaaggugcggagcaacgccgcccugggggccaucuucaccgacgagaacaaguggaaguccgcgcgcgaggccgucgaggacggccgguucugggagcugguggaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcgucgagggggagggccugcaccgccucggcuacauccugcgggacguggggaagaaggagggcggggccauguacgccgacgacaccgccggcugggacacgcgcaucacccuggaggaccucaagaacgaggagauggucaccaaccacaugaagggggagcacaagaagcuggcggaggccaucuucaagcugaccuaccagaacaagguggugcggguccagcgcccgacgccccggggcaccgugauggacaucaucucccgccgggaccagcgcggcagcgggcaggucggcaccuacgggcucaacaccuucacgaacauggaggcccagcugauccgccagauggagggcgagggcaucuucaaguccauccagcaccugaccgccaccgaggagaucgccguccagaacuggcucgcgcggguggggcgcgagcggcugagccgcauggccaucuccggcgacgacugcguggucaagcccaucgacgaccgguucgccagcgcccugaccgcccucaacgacauggggaaggugcgcaaggacauccagcagugggagcccucccggggcuggaacgacuggacccaggugccguucugcagccaccacuuccacgagcuggucaugaaggacgggcgcgugcuggugguccccugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccgugccgccccacugggugccgaccucccggaccacguggagcauccacgccaagcacgaguggaugaccaccgaggacaugcucgcggucuggaaccgcguguggauccaggagaaccccuggauggaggacaagacccccguggaguccugggaggagguccccuaccuggggaagcgggaggaccaguggugcggcagccugaucgggcucacgucccgcgccaccugggccaagaacauccagaccgccaucaaccaggugcggagccugaucggcaacgaggaguacaccgacuacaugccgagcaugaagcgcuuccgccgggaggaggaggaggccggcgugcugugguga

SEQ ID NO: 9258 - RNA, 9876 nt, Artificial Sequence
  derived and/or modified CDS sequence (opt1) from DENV-2__GQ199895__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggaggacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgugacccccaugcugcggcacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggaggucgaccggacccuggcgaaggaggggaucaagcgcggcgagacggaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggaggcccuccagcggaaguacggcggggcgcugguccgcaacccccugucccggaacagcacgcacgagauguacuggguguccaacgccaccggcaacaucgugagcuccgucaacaugaucagccgcaugcugaucaaccgguucaccaugaagcacaagaaggccaccuacgagccggacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacguggucccgauggugacccagauggcgaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcggagcaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacaccgccggcugggacacgcgcaucacccuggaggaccucaagaacgaggagauggugaccaaccacaugaagggggagcacaagaagcuggcggaggccaucuucaagcugaccuaccagaacaaggucgugcgggugcagcgcccgacgccccggggcaccgucauggacaucaucucccgccgggaccagcgcggcagcgggcaggucggcaccuacgggcucaacaccuucacgaacauggaggcccagcugauccgccagauggagggcgagggcaucuucaaguccauccagcaccugaccgccaccgaggagaucgccgugcagaacuggcucgcgcgggucgggcgcgagcggcugagccgcauggccaucuccggcgacgacugcguggugaagcccaucgacgaccgguucgccagcgcccugaccgcccucaacgacauggggaagguccgcaaggacauccagcagugggagcccucccggggcuggaacgacuggacccaggucccguucugcagccaccacuuccacgagcuggugaugaaggacgggcgcguccugguggugcccugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccgugccgccccacugggugccgaccucccggaccacguggagcauccacgccaagcacgaguggaugaccaccgaggacaugcucgcgguguggaaccgcgucuggauccaggagaaccccuggauggaggacaagacccccguggaguccugggaggaggugcccuaccuggggaagcgggaggaccaguggugcggcagccugaucgggcucacgucccgcgccaccugggccaagaacauccagaccgccaucaaccagguccggagccugaucggcaacgaggaguacaccgacuacaugccgagcaugaagcgcuuccgccgggaggaggaggaggccggcgugcugugguga

SEQ ID NO: 9259 - RNA, 9876 nt, Artificial Sequence
  derived and/or modified CDS sequence (opt1) from DENV-2__FJ898478__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgugacccccaugcugcggcacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccuccacgcgccggggcaccgggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagacggaccaccacgccgugucccgggggagcgccaagcugcgcugguucguggagcggaacauggucaccccggagggcaaggugguggaccucggcugcgggcgcggcgggugguccuacuacugcggcgggcugaagaacguccgggaggugaagggccugaccaagggcgggcccggccacgaggagcccauccccaugagcaccuacggguggaaccucgugcgccugcagagcggcgucgacguguucuucacgccgcccgagaagugcgacacccugcucugcgacaucggggaguccagccccaaccccaccaucgaggccggccggacccugcgcgugcugaaccucgucgagaacuggcugaacaacaacacccaguucugcaucaaggugcugaacccguacaugcccuccgugaucgagaagauggaggcccuccagcggaaguacggcggggcgcugguccgcaacccccugagccggaacuccacgcacgagauguacugggugagcaacgccaccggcaacaucguguccagcgucaacaugaucucccgcaugcugaucaaccgguucaccaugaagcacaagaaggccaccuacgagccggacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacguggucccgauggugacccagauggcgaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcgguccaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcaccgccucggcuacauccugcgggacgucgggaagaaggagggcggggccauguacgccgacgacaccgccggcugggacacgcgcaucacccuggaggaccucaagaacgaggagauggugaccaaccacaugaagggggagcacaagaagcuggcggaggccaucuucaagcugaccuaccagaacaaggucgugcgggugcagcgcccgacgccccggggcaccgucauggacaucaucagccgccgggaccagcgcggcuccgggcaggucggcaccuacgggcucaacaccuucacgaacauggaggcccagcugauccgccagauggagggcgagggcaucuucaagagcauccagcaccugaccgccaccgaggagaucgccgugcagaacuggcucgcgcgggucgggcgcgagcggcugucccgcauggccaucagcggcgacgacugcguggugaagcccaucgacgaccgguucgccuccgcccugaccgcccucaacgacauggggaagguccgcaaggacauccagcagugggagcccagccggggcuggaacgacuggacccaggugccguucugcucccaccacuuccacgagcuggugaugaaggacgggcgcguccugguggugcccugccggaaccaggacgagcucaucggccgcgcgcggaucagccagggcgccggguggucccugaaggagaccgccugccugggcaagagcuacgcccagauguggacccucauguacuuccaccgccgggaccugcgccuggccgcgaacgccaucugcuccgccguccccagccacugggugcccaccucccggaccacguggagcauccacgccaagcacgaguggaugaccaccgaggacaugcucgcgguguggaaccgcgucuggauccaggagaacccguggauggaggacaagacccccguggaguccugggaggaggugcccuaccuggggaagcgggaggaccaguggugcggcagccugaucgggcucacgagccgcgccaccugggccaagaacauccagaccgccaucaaccagguccggucccugaucggcaacgaggaguacaccgacuacaugcccagcaugaagcgcuuccgccgggaggaggaggaggccggcgugcugugguga

SEQ ID NO: 9260 - RNA, 9876 nt, Artificial Sequence
  derived and/or modified CDS sequence (opt1) from DENV-2__GQ199869__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacauccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgccgagacccagcacgggaccaucgugauccgcguccaguacgagggcgacggcucccccugcaagauccccuucgagaucacggaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacaccauguggcacgucacgcggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacaccggcacgaucggggccgucagccuggacuucucccccggcaccagcggcucccccaucguggaccggaaggggaagguggucggccucuacgggaacggcguggugacccgcagcggcgccuacgucuccgccaucgcgcagaccgagaaguccaucgaggacaaccccgagaucgaggacgacaucuuccggaagaagcgccugacgaucauggaccugcaccccggggccggcaagaccaagcgguaccuccccgccaucgugcgcgaggccaucaagcgggggcugcgcacccugauccuggccccgacccgcguggucgcggccgagauggaggaggcccuccggggccugcccauccgcuaccagacgcccgccaucaagaccgagcacaccgggcgggagaucguggaccugaugugccacgccaccuucacgaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggggaggagcgggugauccucgcgggccccaugccggucacgcacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacgcugaaccucaucaccgagaugggccgccugcccaccuucaugacccagaaggcccggaacgcccuggacaaccucgccguccugcacacggccgaggccgggggccgcgccuacaaccacgcccugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugacguacguggugaucgccauccucaccgucguggccgcgaccauggccaacgagaugggcuuccuggagaagaccaagaaggaccuggggcucggcagcaucacgacccaggagagcgaguccaacauccuggacaucgaccugcgcccggccagcgccuggacccucuacgccguggcgaccacguucgucacccccaugcugcggcacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacgcugaccgccgcccuccugcugcucgucgcccacuacgccaucaucgggcccggccugcaggcgaaggccacccgcgaggcccagaagcgggccgccgcgggcaucaugaagaaccccaccguggacgggaucacggugaucgaccuggagcccaucccguacgaccccaaguucgagaagcagcucggccaggucaugcugcugauccucugcgugacccaggugcugaugaugcgcaccaccugggcccugugcgaggcccucacgcuggccaccgggcccaucuccacccugugggagggcaaccccgggcgguucuggaacaccacgaucgccgucagcauggcgaacaucuuccgcggcuccuaccucgccggcgccgggcugcuguucagcaucaugaagaacaccaccuccacccgccggggcacggggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagaccgaccaccacgccgugucccgggggagcgccaagcugcgcugguucgucgagcggaacauggugacgccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucaccccgcccgagaagugcgacacgcugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacccacgagauguacugggugagcaacgccacgggcaacaucgucuccagcgugaacaugaucucccgcaugcugaucaaccgguucaccaugaagcacaagaaggccaccuacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccugcugaccaagcccugggacgucgugccgauggugacgcagauggcgaugaccgacaccacccccuucgggcagcagcgcgucuucaaggagaagguggacacgcggacccaggagcccaaggagggcaccaagaagcucaugaagaucaccgccgaguggcuguggaaggagcugggcaagaagaagacgccccgcaugugcacccgggaggaguucaccaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagacgugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacccuggaggaccugaagaacgaggagauggucacgaaccacaugaagggggagcacaagaagcucgcggaggccaucuucaagcugaccuaccagaacaagguggugcgcguccagcggccgacgccccgcggcaccgugauggacaucaucagccggcgcgaccagcggggcuccgggcaggucggcacguacgggcugaacaccuucaccaacauggaggcccagcucauccgccagauggagggcgagggcaucuucaagagcauccagcaccugaccgccacggaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacgcugauguacuuccaccggcgcgaccuccggcuggccgcgaacgccaucugcuccgccgugcccagccacugggugcccaccucccgcaccaccuggagcauccacgccaagcacgaguggaugaccacggaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccaccugggccaagaacauccagacggccaucaaccaggugcgcucccucaucggcaacgaggaguacaccgacuacaugcccagcaugaagcgguuccgccgcgaggaggaggaggccggcgugcugugguga

SEQ ID NO: 9261 - RNA, 9876 nt, Artificial Sequence
  derived and/or modified CDS sequence (opt1) from DENV-2__JX079688__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucuggcacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucacgccgcccgagaagugcgacacccugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucaccaagaaggugcgcuccaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggccgacgccccgcggcacggugauggacaucaucagccggcgcgaccagcggggcuccgggcaggucggcaccuacgggcugaacaccuucaccaacauggaggcccagcucauccgccagauggagggcgagggcaucuucaagagcauccagcaccugacggccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccacgugggccaagaacauccagaccgccaucaaccaggugcgcucccucaucggcaucgaggaguacaccgacuacaugcccagcaugaagcgguuccgccgcgaggaggaggaggccggcgugcugugguga

SEQ ID NO: 9262 - RNA, 9876 nt, Artificial Sequence
  derived and/or modified CDS sequence (opt1) from DENV-2__JF357906__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcggugcuggccuacaccaucgggaccacgcacuuccagaaggcccucaucuucauccugcugaccgccgucgcgcccagcaugaccaugcggugcaucggcaucagcaaccgcgacuucguggagggcgugagcgggggcagcugggucgacaucgugcucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccauggucgaccgcggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccgccagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgucauccgggugcaguacgagggcgacggcucccccugcaagauccccuucgagaucaccgaccuggagaagcgccacgugcucgggcggcugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagacgaccaugcgcggcgccaagcgcauggccauccugggggacaccgccugggacuucggcagccucggcgggguguucaccuccaucgggaaggcccuccaccagguguucggggcgaucuacggcgccgccuucagcggggucuccuggacgaugaagauccugaucggcgugaucaucaccuggaucgggaugaacagccgguccaccagccuguccgugagccugguccucgugggcguggucacccuguaccugggggccguggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccgcagcgucacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacccggaucggcacgaagcacgcgauccugcucgucgccgugagcuucgugacccugaucaccgggaacauguccuuccgcgaccugggccgggucauggugauggugggggccaccaugacggacgacaucggcaugggcgucaccuaccucgcccugcuggccgcguucaaggugcgccccaccuucgccgccgggcuccugcugcgcaagcucaccagcaaggagcugaugauggccacgaucggcaucgcccugcucucccagagcaccauccccgagaccauccuggagcugaccgacgcgcucgcccuggggaugauggugcugaagaucguccggaacauggagaaguaccagcucgccgugacgaucauggccaucuccugcgugccgaacgccgucauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccgugggcauggucagcauccucgccuccagccugcugaagaacgacauccccaugacggggccccucguggcgggcgggcugcugaccgugugcuacguccucaccggccgcagcgccgaccuggagcuggagcgggccgccgacgugaagugggaggaccaggccgagaucuccgggagcucccccauccucagcaucaccaucuccgaggacggcagcauguccaucaagaacgaggaggaggagcagacgcugaccauccugauccgcaccggccuccuggugaucagcgggaucuucccggucuccauccccaucaccgcggccgccugguaccugugggaggugaagaagcagcgggccggcgugcucugggacguccccagcccgccgcccguggagaaggccgagcuggaggacggggcguaccgcaucaagcagcggggcauccugggguacucccagaucggcgccggcguguacaaggaggggaccuuccacacgauguggcacgucacccgcggcgccgugcucaugcaccgggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggaucuucaagaccaacacgggcaccaucggggccgucagccuggacuucucccccggcaccagcggcucccccaucguggaccgcaaggggaagguggucggccucuacgggaacggcguggugacccggagcggcgccuacgucuccgccaucgcgcagacggagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcggacccugauccuggccccgacgcgcguggucgcggccgagauggaggaggcccuccgcggccugcccauccgguaccagacccccgccaucaagaccgagcacaccgggcgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccuccgcaagaacggcaagaaggugauccagcugagccggaagacguucgacuccgaguacgucaagacccgcgccaacgacugggacuucguggugaccaccgacaucagcgagaugggcgccaacuucaaggccgagcgggucaucgacccccgccggugcaugaagcccgugauccugacggacggggaggagcgcgugauccucgcgggccccaugccggucacccacuccagcgccgcccagcggcgcgggcggaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgcgagaagguggacgcgaucgacggcgaguaccggcugcgcggggaggcccggaagaccuucguggaccugaugcgccggggcgaccuccccgucuggcuggccuacaagguggccgccgaggggaucaacuacacggaccgcaaguggugcuucgacggcaucaagaacaaccagauccuggaggagaacauggagguggagaucuggaccaaggagggggagcggaagaagcucaagccgcgcuggcuggacgcgcggaucuacagcgacccccuggcccucaaggaguucaaggaguucgccgccggccgcaagucccugacccugaaccucaucaccgagaugggccggcugcccacguucaugacccagaaggcgcgcaacgcccuggacaaccucgccguccugcacaccgccgaggccgggggccgggcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcgcacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcggccggccagcgccuggacgcucuacgccguggccaccaccuucgucacccccaugcugcgccacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgggaggcccagaagcgcgccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcggacgaccugggcgcugugcgaggcccucacccuggccaccgggcccaucuccacgcugugggagggcaaccccgggcgcuucuggaacaccaccaucgccgucagcauggccaacaucuuccggggcuccuaccucgcgggcgccgggcugcuguucagcaucaugaagaacaccacguccacccgccgcggcaccgggaacaucggcgagacccucggcgagaaguggaagucccggcugaacgcccuggggaaguccgaguuccagaucuacaagaaguccggcauccaggagguggaccgcacgcucgccaaggaggggaucaagcggggcgagaccgaccaccacgcggugucccgcgggagcgccaagcugcggugguucgucgagcgcaacauggugaccccggagggcaagguggucgaccugggcugcgggcggggcgggugguccuacuacugcggcgggcucaagaacgugcgcgaggugaagggccugaccaagggcgggcccggccacgaggagcccauccccaugagcacguacggguggaaccugguccggcuccagagcggcguggacguguucuucaccccgcccgagaagugcgacacccugcugugcgacaucggggaguccagccccaaccccaccaucgaggccggccgcacccuccggguccugaaccugguggagaacuggcucaacaacaacacgcaguucugcaucaaggugcugaacccguacaugcccuccgucaucgagaagauggaggcccugcagcgccaguacggcggggcccucgugcggaacccccugagccgcaacuccacccacgagauguacugggugagcaacgcgaccggcaacaucgucuccagcgugaacaugaucucccggaugcugaucaaccgcuucaccaugaagcacaagaaggccacguacgagccggacguggaccuggggagcggcacccggaacaucgggaucgaguccgagauccccaaccucgacaucaucggcaagcgcaucgagaagaucaagcaggagcacgagaucagcuggcacuacgaccaggaccaccccuacaagaccugggccuaccacggcuccuacgagaccaagcagacggggagcgccuccagcauggucaacggcguggugcggcugcugaccaagcccugggacgucgugccgauggugacccagauggccaugaccgacacgacccccuucgggcagcagcgcgucuucaaggagaagguggacacccgcacccaggagcccaaggagggcacgaagaagcucaugaagaucaccgcggaguggcuguggaaggagcugggccggaagaagacgccccgcaugugcacccgggaggaguucacgcgcaaggugcgguccaacgccgcccucggggccaucuucaccgacgagaacaaguggaaguccgcccgcgaggcggucgaggacggccgguucugggagcugguggaccgcgagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacagccucuccggggucgagggcgaggggcugcaccgccugggcuacauccuccgggacgugggcaagaaggagggcggcgccauguacgccgacgacaccgccgggugggacacgcgcaucacccuggaggaccugaagaacgaggagauggucaccaaccacaugaagggcgagcacaagaagcucgccgaggcgaucuucaagcugaccuaccagaacaagguggugcggguccagcgcccgacgccccgggggaccgugauggacaucaucagccgccgggaccagcgcggcuccggccagguggggaccuacggccugaacaccuucacgaacauggaggcccagcucauccgccagauggagggggagggcaucuucaagagcauccagcaccugaccgccaccgaggagaucgccguccagaacuggcuggcccgggugggccgcgagcggcucucccgcauggcgaucagcggggacgacugcguggucaagcccaucgacgaccgguucgccuccgcccugaccgcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucgggcgcgcccggaucagccagggcgcgggcuggucccucaaggagaccgccugccugggcaagagcuacgcccagauguggacccugauguacuuccaccgccgggaccuccgccuggccgccaacgcgaucugcuccgccgugcccagccacugggugcccaccucccggaccacgugguacauccacgccaagcacgaguggaugaccaccgaggacaugcuggccgucuggaaccgcguguggauccaggagaacccguggauggaggacaagacccccguggagagcugggaggagguccccuaccucggcaagcgggaggaccaguggugcgggucccugaucggccugacgagccgcgcgaccugggccaagaacauccagaccgccaucaaccaggugcggagccucaucgggaacgaggaguacaccgacuacaugcccuccaugaagcgcuuccgccgggaggaggaggaggccggcgugcugugguga

SEQ ID NO: 9263 - RNA, 9873 nt, Artificial Sequence
  derived and/or modified CDS sequence (opt1) from DENV-2__HQ705624__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgaaguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaaggugcccuucgagaucaccgaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccagguguucggcgcgaucuacggcgccgccuucagcggggucuccuggacgaugaagauccugaucggcgugaucaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccaucaagaaggcccacgaggagggcaucugcgggauccggagcgugacccgccuggagaaccucauguggaagcagaucacgcccgagcugaaccacauccuguccgagaacgaggucaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucgggguguucaccaccaacaucuggcucaagcugcgggacaagcaggacgucuucugcgacuccaagcugaugagcgccgccaucaaggacaaccgcgcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccguggucgugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgucaccgccgggcacggccagaucgacaacuucucccugggcgugcuggggauggcccuccugcuggaggagaugcuccgcacccggaucggcacgaagcacgcgauccugcugguggccgucagcuucgugacccucaucaccgggaacauguccuuccgcgaccugggccgcgugauggucauggugggggccaccaugacggacgacaucggcaugggcgugaccuaccuggcccuccuggccgcguucaagguccggcccaccuucgccgccgggcugcuccugcgcaagcugaccagcaaggagcucaugauggccacgaucggcaucgcccugcugucccagagcaccauccccgagaccauccucgagcugaccgacgcgcuggcccucgggaugauggugcugaagaucgugcggaacauggagaaguaccagcuggccgucacggugauggccaucuccugcgugccgaacgccgucauccuccagaacgcguggaaggugagcugcaccauccuggccgccgucuccgugagcccccugcuccugaccuccagccagcagaaggccgacuggaucccccuggcgcucaccaucaagggccugaaccccacggccaucuuccugaccacccucucccgcaccagcaagaagcgguccuggccgcugaacgaggccaucauggccgugggcauggucagcauccuggccuccagccuccugaagaacgacauccccaugacggggccccugguggcgggcgggcuccugaccgugugcuacguccugaccggccgcagcgccgaccucgagcuggagcgggccgccgacgugaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcggggucuucccgguguccauccccaucaccgcggccgccugguaccugugggaggugaagaagcagcgggccggcguccugugggacgugcccagcccgccgcccguggagaaggccgagcucgaggacggggcguaccgcaucaagcagcggggcauccugggguacucccagaucggcgccggcgucuacaaggaggggaccuuccacacgauguggcacgugacccgcggcgccgugcugaugcaccgggggaagcgcaucgagcccagcugggccgacgucaagaaggaccucaucuccuacggcgggggcuggaagcuggagggcgaguggaaggagggggaggagguccaggugcuggcccucgagcccggcaagaacccccgggcgguccagaccaagcccgggaucuucaagaccaacacgggcaccaucggggccgugagccuggacuuccccggcaccuccggcagccccaucguggaccgcaaggggaaggucgugggccuguacgggaacggcguggucacccgguccggcgccuacgugagcgccaucgcgcagacggagaaguccaucgaggacaaccccgagaucgaggacgacaucuuccgcaagaagcggcucaccaucauggaccugcaccccggggccggcaagaccaagcgcuaccugcccgccaucgugcgggaggccaucaagcgcgggcugcgcacccucauccuggccccgacgcgggucguggcggccgagauggaggaggcccugcgcggccuccccauccgguaccagaccaccgccaucaagaccgagcacacggggcgcgagaucguggaccugaugugccacgccaccuucaccaugcggcugcucagccccguccgcgugcccaacuacaaccugaucaucauggacgaggcgcacuucaccgacccggccagcaucgccgcccggggcuacaucuccacgcgcguggagaugggcgaggccgcggggaucuucaugaccgccacgccgcccggcagccgggaccccuucccgcaguccaacgcccccaucauggacgaggagcgcgagauccccgagcggagcuggaacuccgggcacgagugggucaccgacuucaagggcaagacggugugguucgugcccagcaucaaggccgggaacgacaucgcggccugccugcgcaagaacggcaagaaggucauccagcucucccggaagaccuucgacagcgaguacgugaagacccgcgccaacgacugggacuucguggucaccacggacaucuccgagaugggcgccaacuucaaggccgagcgggugaucgacccgcgccggugcaugaagcccgugauccugaccgacggggaggagcgcgucauccuggcgggccccaugcccgugacccacagcuccgccgcccagcggcgcgggcgcaucggccggaacccgaagaacgagaacgaccaguacaucuacaugggggagccccucgagaacgacgaggacugcgcccacuggaaggaggccaagaugcugcuggacaacaucaacacccccgagggcaucauccccagcauguucgagccggagcgcgagaagguggacgcgaucgacggcgaguaccggcuccgcggggaggcccggaagacguucgucgaccugaugcgccggggcgaccugcccguguggcucgccuacaagguggccgccgaggggaucaacuacgcggaccgcaaguggugcuucgacggcaucaagaacaaccagauccuggaggagaacauggaggucgagaucuggaccaaggagggggagcggaagaagcugaagccccgcuggcucgacgcccggaucuacuccgacccgcuggcccugaaggaguucaaggaguucgccgcgggccgcaagagccucacccugaaccugaucaccgagaugggccggcuccccacguucaugacccagaaggcccgcaacgcccuggacaaccuggccgugcuccacaccgccgaggccgggggccgggccuacaaccacgcccuguccgagcugcccgagacccucgagacgcugcugcuccugacccugcucgccaccgucaccgggggcaucuuccuguuccugaugagcggcaaggggaucggcaagaugacccucgggaugugcugcaucaucacggccuccauccugcugugguacgcgcagauccagccccacuggaucgccgccagcaucauccucgaguucuuccugaucgugcugcucaucccggagcccgagaagcagcgcacgccccaggacaaccagcugaccuacguggucaucgccauccugaccgugguggccgcgacgauggccaacgagaugggcuuccucgagaagaccaagaaggaccuggggcugggcuccaucaccacccaggagagcgagagcaacauccucgacaucgaccugcggcccgccuccgccuggacgcuguacgccgucgcgaccaccuucgugaccccgaugcuccgccacagcaucgagaacuccagcgugaacgucucccugacggccaucgccaaccaggccaccgugcugaugggccucgggaagggcuggccccugagcaagauggacaucggggugccccugcucgcgaucggcugcuacucccaggucaaccccaucacccugaccgccgcccugcuccugcugguggcccacuacgccaucaucgggccgggccuccaggcgaaggccacgcgggaggcccagaagcgcgccgccgcgggcaucaugaagaaccccaccguggacgggaucaccgucaucgaccuggagcccauccccuacgacccgaaguucgagaagcagcugggccaggugaugcuccugauccugugcgugacccagguccucaugaugcggacgaccugggcccugugcgaggcccugacccucgccaccgggcccaucagcacgcugugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaucggcgagacccugggcgagaaguggaagucccggcucaacgcccuggggaaguccgaguuccagaucuacaagaaguccggcauccaggagguggaccgcacgcuggcgaaggaggggaucaagcggggcgagaccgaccaccacgccgucucccgcgggagcgccaagcuccggugguucguggagcgcaacauggugacccccgagggcaaggucguggaccugggcugcgggcggggcgggugguccuacuacugcggcgggcugaagaacgugcgcgaggucaagggccucaccaagggcgggccgggccacgaggagcccauccccaugagcacguacggguggaaccuggugcggcugcaguccggcguggacgucuucuucacgccgcccgagaagugcgacacccuccugugcgacaucggggagagcagccccaaccccaccaucgaggccggccgcacccugcgggugcucaaccugguggagaacuggcugaacaacaacacgcaguucugcaucaagguccucaaccccuacaugcccuccgugaucgagaagauggaggcccugcagcgcaaguacggcggggcgcuggugcggaacccccugagccgcaacuccacccacgagauguacugggucagcaacgccaccggcaacaucguguccagcgugaacaugaucucccggaugcucaucaaccgcuucaccaugaagcacaagaaggccacguacgagcccgacgucgaccuggggagcggcacccggaacaucgggaucgaguccgagaucccgaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccuccugaccaagcccugggacguggugcccauggucacccagauggcgaugacggacaccaccccguucgggcagcagcggguguucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaagguccgcuccaacgccgcccugggggccaucuucaccgacgagaacaaguggaaguccgcgcgggaggccguggaggacggccgcuucugggagcucguggaccgggagcgcaaccugcaccuggaggggaagugcgagaccugcgucuacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgggaacucccugagcggcguggagggggagggccuccaccggcugggcuacauccugcgcgacgucgggaagaaggagggcggggccauguacgccgacgacacggccggcugggacacccggaucacccucgaggaccugaagaacgaggagauggugaccaaccacaugaagggggagcacaagaagcuggcggaggccaucuucaagcucacguaccagaacaaggugguccgcgugcagcggcccaccccgcgcggcaccgugauggacaucaucagccggcgcgaccagcgcggcuccgggcaggucggcaccuacgggcugaacacguucaccaacauggaggcccagcugauccggcagauggagggcgagggcaucuucaagagcauccagcaccucaccgccaccgaggagaucgccgugcagaacuggcuggcgcgcguggggcgggagcgccugucccggauggccaucagcggcgacgacugcgucgugaagcccaucgacgaccgcuucgccuccgcccucacggcccugaacgacauggggaaggugcggaaggacauccagcagugggagcccagccgcggcuggaacgacuggacccagguccccuucugcucccaccacuuccacgagcuggugaugaaggacgggcgggugcucgucgugccgugccgcaaccaggacgagcugaucggccgggcgcgcaucagccagggcgccggguggucccugaaggagaccgccugccucggcaagagcuacgcccagauguggacccugauguacuuccaccggcgcgaccugcggcucgccgcgaacgccaucugcuccgccgugcccagccacuggguccccaccucccgcacgaccuggagcauccacgccaagcacgaguggaugaccaccgaggacaugcuggcgguguggaaccggguguggauccaggagaaccccuggauggaggacaagacgccggucgaguccugggaggaggugcccuaccuggggaagcgcgaggaccaguggugcggcagccucaucgggcugaccucccgggccaccugggccaagaacauccagaccgccaucaaccaggugcgcagccugaucggcaacgaggaguacacggacuacaugcccagcaugaagcgcuuccggcgcgaggaggaggaggccggcguccucugguga

SEQ ID NO: 9264 - RNA, 9876 nt, Artificial Sequence
  derived and/or modified CDS sequence (opt1) from DENV-2__HQ705625__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaugaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcacgaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggcccggaacgcccuggacaaccucgccguccugcacaccgccgaggccgggggccgcgccuacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgacgauggccaacgagaugggcuuccuggagaagaccaagaaggaccuggggcucggcagcaucaccacccaggagagcgaguccaacauccuggacaucgaccugcgcccggccagcgccuggacgcucuacgccguggcgaccaccuucgucacccccaugcugcggcacuccaucgagaacagcuccgugaacgugagccugacggccaucgccaaccaggccaccguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacgcgcgaggcccagaagcgggccgccgcgggcaucaugaagaaccccaccguggacgggaucaccgugaucgaccuggagcccaucccguacgaccccaaguucgagaagcagcucggccaggucaugcugcugauccucugcgugacccaggugcugaugaugcgcacgaccugggcccugugcgaggcccucacccuggccaccgggcccaucuccacgcugugggagggcaaccccgggcgguucuggaacaccaccaucgccgucagcauggcgaacaucuuccgcggcuccuaccucgccggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgcgaaggaggggaucaagcgcggcgagaccgaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcacguacggguggaaccugguccgccuccagagcggcguggacguguucuucaccccgcccgagaagugcgacacccugcugugcgacaucggggaguccagccccaaccccaccaucgaggccggccggacccuccgcguccugaaccugguggagaacuggcucaacaacaacacgcaguucugcaucaaggugcugaacccguacaugcccuccgucaucgagaagauggaggcccugcagcggcaguacggcggggcgcucgugcgcaacccccugagccggaacuccacccacgagauguacugggugagcaacgccaccggcaacaucgucuccagcgugaacaugaucucccgcaugcugaucaaccgguucaccaugaagcacaagaaggccacguacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcugaccaagcccugggacgucgugccgauggugacccagauggcgaugaccgacacgacccccuucgggcagcagcgcgucuucaaggagaagguggacacccggacccaggagcccaaggagggcacgaagaagcucaugaagaucaccgccgaguggcuguggaaggagcugggcaagaagaagacgccccgcaugugcacccgggaggaguucacgaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacgcggaucacccuggaggaccugaagaacgaggagauggucaccaaccacaugaagggggagcacaagaagcucgcggaggccaucuucaagcugaccuaccagaacaagguggugcgcguccagcggccgacgccccgcggcaccgugauggacaucaucagccggcgcgaccagcggggcuccgggcaggucggcaccuacgggcugaacaccuucacgaacauggaggcccagcucauccgccagauggagggcgagggcaucuucaagagcauccagcaccugaccgccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacccugauguacuuccaccggcgcgaccuccggcuggccgcgaacgccaucugcuccgccgugcccagccacugggugcccaccucccgcaccacguggagcauccacgccaagcacgaguggaugaccaccgaggacaugcuggcggucuggaaccggguguggauccaggagaacccguggauggaggacaagacccccguggaguccugggaggagguccccuaccucgggaagcgcgaggaccaguggugcggcagccugaucgggcugacgagccgggccaccugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9265 - RNA, 9876 nt, Artificial Sequence
  derived and/or modified CDS sequence (opt1) from DENV-2__JF730052__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaugaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaccaccgggaacauguccuuccgggaccugggccgcgugauggucauggugggggccacgaugaccgacgacaucggcaugggcgugaccuaccucgcccugcuggccgcguucaagguccgccccaccuucgccgccgggcuccugcugcggaagcucacgagcaaggagcugaugauggccaccaucggcaucgcccugcucucccagagcaccauccccgagaccauccuggagcugacggacgcgcucgcccuggggaugauggugcugaagaucgugcgcaacauggagaaguaccagcucgccgucaccaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugacgaucaagggccugaaccccaccgccaucuuccucaccacccugucccggacgagcaagaagcgcuccuggccgcugaacgaggccaucauggccgugggcauggugagcauccucgccuccagccugcugaagaacgacauccccaugaccgggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucacgaucuccgaggacggcagcauguccaucaagaacgaggaggaggagcagacccugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggacguuccacaccauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagacgaacaccggcaccaucggggccgucagccuggacuucucccccggcaccagcggcucccccaucguggaccggaaggggaagguggucggccucuacgggaacggcguggugacgcgcagcggcgccuacgucuccgccaucgcgcagaccgagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacgcugauccuggccccgacccgcguggucgcggccgagauggaggaggcccuccggggccugcccauccgcuaccagacccccgccaucaagaccgagcacacggggcgggagaucguggaccugaugugccacgccaccuucaccaugcgccuccugagccccgugcgggucccgaacuacaaccugaucaucauggacgaggcgcacuucaccgaccccgccuccaucgccgcccgcggcuacaucagcacgcggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagacggucugguucgugccguccaucaaggccgggaacgacaucgcggccugccuccggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccccggcgcugcaugaagcccgugauccugaccgacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagacguucguggaccugaugcggcgcggcgaccuccccgucuggcuggccuacaagguggccgccgaggggaucaacuacgcggaccggaaguggugcuucgacggcaccaagaacaaccagauccuggaggagaacauggagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucacggagaugggccgccugcccaccuucaugacccagaaggcccggaacgcccuggacaaccucgccguccugcacaccgccgaggccgggggccgcgccuacaaccacgcccugagcgagcuccccgagacgcuggagacccugcuccugcugacccuccuggccaccgugaccgggggcaucuuccuguuccucauguccggcaaggggaucggcaagaugacgcuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucacggucguggccgcgaccauggccaacgagaugggcuuccuggagaagaccaagaaggaccuggggcucggcagcaucaccacgcaggagagcgaguccaacauccuggacaucgaccugcgcccggccagcgccuggacccucuacgccguggcgaccaccuucgucacgcccaugcugcggcacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacccugacggccgcccuccugcugcucgucgcccacuacgccaucaucgggcccggccugcaggcgaaggccacccgcgaggcccagaagcgggccgccgcgggcaucaugaagaaccccaccguggacgggaucaccgugaucgaccuggagcccaucccguacgaccccaaguucgagaagcagcucggccaggucaugcugcugauccucugcgugacccagguccugaugaugcgcaccaccugggcccugugcgaggcccucacccuggccacggggcccaucuccacccugugggagggcaaccccgggcgguucuggaacaccaccaucgccgucagcauggcgaacaucuuccgcggcuccuaccucgccggcgccgggcugcuguucagcaucaugaagaacacgaccuccacccgccggggcaccgggaacaucggcgagacgcucggcgagaaguggaagucccgccugaacgcccuggggaaguccgaguuccagaucuacaagaaguccggcauccaggagguggaccggacccucgcgaaggaggggaucaagcgcggcgagaccgaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugacgaagggcgggcccggccacgaggagcccauccccaugagcaccuacggguggaaccugguccgccuccagagcggcguggacguguucuucaccccgcccgagaagugcgacacccugcugugcgacaucggggaguccagccccaaccccaccaucgaggccggccggacgcuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacccacgagauguacugggugagcaacgccaccggcaacaucgucuccagcgugaacaugaucucccgcaugcugaucaaccgguucacgaugaagcacaagaaggccaccuacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagacgaagcagaccgggagcgccuccagcauggucaacggcguggugcgccugcugaccaagcccugggacgucgugccgauggugacccagauggcgaugacggacaccacccccuucgggcagcagcgcgucuucaaggagaagguggacacccggacgcaggagcccaaggagggcaccaagaagcucaugaagaucaccgccgaguggcuguggaaggagcugggcaagaagaagacgccccgcaugugcacgcgggaggaguucaccaagaaggugcgcuccaacgccgcccucggggccaucuucaccgacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacacggccggcugggacacccggaucacccuggaggaccugaagaacgaggagauggucaccaaccacaugaagggggagcacaagaagcucgcggaggccaucuucaagcugacguaccagaacaagguggugcgcguccagcggccgacgccccgcggcaccgugauggacaucaucagccggcgcgaccagcggggcuccggccaggugggcaccuacgggcugaacacguucaccaacauggaggcccagcucauccgccagauggagggcgagggcaucuucaagagcauccagcaccugaccgccaccgaggagaucgccguccagaacuggcuggcgcgcguggggcgggagcgccucucccggauggccaucagcggcgacgacugcguggucaagcccaucgacgaccgcuucgccuccgcccugacggcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagaccgccugccugggcaagagcuacgcccagauguggacccugauguacuuccaccggcgcgaccuccggcuggccgcgaacgccaucugcuccgccgugcccagccacugggugcccaccucccgcacgaccuggagcauccacgccaagcacgaguggaugaccaccgaggacaugcuggcggucuggaaccggguguggauccaggagaacccguggauggaggacaagacgcccguggaguccugggaggagguccccuaccucgggaagcgcgaggaccaguggugcggcagccugaucgggcugaccagccgggccaccugggccaagaacauccagaccgccaucaaccaggugcgcucccucaucggcaacgaggaguacacggacuacaugcccagcaugaagcgguuccgccgcgaggaggaggaggccggcgugcugugguga

SEQ ID NO: 9266 - RNA, 9876 nt, Artificial Sequence
  derived and/or modified CDS sequence (opt1) from DENV-2__EU482748__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggagaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgugacccccaugcugcggcacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccuccacgcgccggggcaccgggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagacggaccaccacgccgugucccgggggagcgccaagcugcgcugguucguggagcggaacauggucaccccggagggcaaggugguggaccucggcugcgggcgcggcgggugguccuacuacugcggcgggcugaagaacguccgggaggugaagggccugaccaagggcgggcccggccacgaggagcccauccccaugagcaccuacggguggaaccucgugcgccugcagagcggcgucgacguguucuucacgccgcccgagaagugcgacacccugcucugcgacaucggggaguccagccccaaccccaccaucgaggccggccggacccugcgcgugcugaaccucgucgagaacuggcugaacaacaacacccaguucugcaucaaggugcugaacccguacaugcccuccgugaucgagaagauggaggcccuccagcggaaguacggcggggcgcugguccgcaacccccugagccggaacuccacgcacgagauguacugggugagcaacgccaccggcaacaucguguccagcgucaacaugaucucccgcaugcugaucaaccgguucaccaugaagcacaagaagaccacguacgagccggacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacguggucccgauggugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagacgccccgcaugugcacgcgggaggaguucacccgcaaggugcgguccaacgccgcccugggggccaucuucaccgacgagaacaaguggaaguccgcccgcgaggcgguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcccgcuuccuggaguucgaggcgcugggcuuccucaacgaggaccacugguucagccgggggaacagccuguccggcguggagggggagggccugcaccgccucggcuacauccugcgggacgucagcaagaaggagggcggcgccauguacgccgacgacacggccgggugggacacccgcaucacccuggaggaccucaagaacgaggagauggugaccaaccacaugaagggcgagcacaagaagcuggccgaggcgaucuucaagcugacguaccagaacaaggucgugcgggugcagcgcccgacgccccgggggaccgucauggacaucaucucccgccgggaccagcgcggcagcggccagguggggaccuacggccucaacacguucaccaacauggaggcccagcugauccgccagauggagggggagggcaucuucaaguccauccagcaccugaccgccaccgaggagaucgugguccagaacuggcucgcccgggugggccgcgagcggcugagccgcauggccaucuccggggacgacugcguggucaagcccaucgacgaccgguucgcgagcgcccugacggcccucaacgacaugggcaaggugcgcaaggacauccagcagugggagcccucccggggguggaacgacuggacccaggugccguucugcagccaccacuuccacgagcuggucaugaaggacggccgcgugcuggugguccccugccggaaccaggacgagcucaucgggcgcgcccggaucucccagggcgccggcuggagccugaaggagaccgcgugccuggggaaguccuacgcccagauguggacccucauguacuuccaccgccgggaccugcgccuggccgccaacgccaucugcagcgcggugcccucccacugggugcccaccagccggacgaccugguccauccacgccaagcacgaguggaugaccaccgaggacaugcucgccgucuggaaccgcguguggauccaggagaacccguggauggaggacaagacgcccguggagagcugggaggagguccccuaccugggcaagcgggaggaccaguggugcgggagccugaucggccucaccucccgcgccaccugggcgaagaacauccagaccgccaucaaccaggugcggagccugaucgggaacgaggaguacacggacuacaugcccuccaugaagcgcuuccgccgggaggaggaggaggccggcgugcugugguga

SEQ ID NO: 9267 - RNA, 9876 nt, Artificial Sequence
  derived and/or modified CDS sequence (opt1) from DENV-2__EU482749__SS-prME
accgcgggcgugaucgucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagaccaucgagaccuggauccugcggcacccgggcuucaccaucauggccgcgauccuggccuacaccaucgggacgacccacuuccagcgcgcccucaucuucauccugcugaccgccguggcgcccagcaugaccaugcggugcaucggcaucagcaaccgcgacuucgucgagggcgugagcgggggcuccuggguggacaucguccucgagcacgggagcugcgugacgaccauggccaagaacaagcccacccuggacuucgagcugaucaagaccgaggccaagcagcccgccacgcuccggaaguacugcaucgaggccaagcugaccaacaccaccacggagucccgcugcccgacccagggcgagcccagccuguccgaggagcaggacaagcgguucaucugcaagcacagcaugguggaccgcggcugggggaacggcugcgggcuguucggcaagggcgggaucgugaccugcgcgauguucacgugcaagaagaacauggagggcaagguggugcagcccgagaaccuggaguacacgaucgucaucacgccccacuccggggaggagcacgccgugggcaacgacaccgggaagcacggcaaggagaucaagaucaccccgcagagcuccaucaccgaggccgagcugacgggguacggcaccgugaccauggagugcagcccccggaccggccucgacuucaacgagaugguccugcugcagauggaggacaaggccuggcucgugcaccgccagugguuccuggaccugccccuccccuggcugccgggggccgacacgcagggcuccaacuggauccagaaggagacccuggugaccuucaagaacccccacgcgaagaagcaggacgucgugguccucgggagccaggagggcgccaugcacaccgcccugacgggggccaccgagauccagaugagcuccggcaaccuccuguucaccggccaccugaagugccggcugcgcauggacaagcuccagcugaaggggaugagcuacuccaugugcaccggcaaguucaagaucgugaaggagaucgccgagacgcagcacgggaccaucgugauccggguccaguacgagggcgacggcagccccugcaagauccccuucgagaucaccgaccuggagaagcgccacgugcucgggcggcugaucaccgugaacccgaucgucacggagaaggacucccccgugaacaucgaggcggagccgcccuucggcgacagcuacaucaucaucgggguggagccgggccagcugaagcucaacugguucaagaagggguccagcaucggccagauguucgagaccaccaugcgcggcgccaagcgcauggccauccugggggacaccgccugggacuucggcucccucgggggcgucuucacgagcaucgggaaggcccuccaccagguguucggcgcgaucuacggcgccgccuucuccggggugagcuggaccaugaagauccugaucggcgucaucaucaccuggaucgggaugaacucccggagcaccucccugagcgugucccuggugcucgucggcguggugacgcuguaccugggggccaugguccaggcggacagcggcugcgugguguccuggaagaacaaggagcucaagugcggcagcgggaucuucaucaccgacaacguccacaccuggaccgagcaguacaaguuccagcccgagagccccuccaagcuggccagcgccauccagaaggcccacgaggagggcaucugcgggauccgcuccgugacgcggcuggagaaccucauguggaagcagaucacccccgagcugaaccacauccugagcgagaacgaggugaagcucaccaucaugaccggcgacauccgcgggaucaugcaggccggcaagcggucccugcgcccgcagcccacggagcugaaguacagcuggaagaccuggggcaaggcgaagaugcucuccaccgagagccacaaccagaccuuccugaucgacgggcccgagacggccgagugcccgaacaccaaccgggccuggaacucccuggaggucgaggacuacggcuucgggguguucaccaccaacaucuggcucaagcugcgcgagaagcaggacguguucugcgacagcaagcugauguccgccgccaucaaggacaaccgggcgguccacgccgacaugggcuacuggaucgagagcgcccucaacgacaccuggaagauggagaaggccuccuucaucgaggucaagagcugccacuggcccaagucccacacgcuguggagcaacggcgugcuggaguccgagaugaucauccccaagaacuucgccgggcccgugagccagcacaacuaccgcccgggcuaccacacccagaccgcggggcccuggcaccucggcaagcuggagauggacuucgaccugugcgaggggaccacggugguggucaccgaggacugcggcaaccggggccccagccuccgcaccaccacggccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacgcgcaucggcaccaagcacgcgauccuccugguggccguguccuucgucacccugaucaccgggaacaugagcuuccgggaccucggccgcgugauggugauggucggggccacgaugaccgacgacaucggcaugggcgugaccuaccuggcccugcucgccgcguucaaggugcgccccaccuucgccgccgggcugcugcuccggaagcugacguccaaggagcugaugauggccaccaucggcaucgcccuccugagccaguccaccauccccgagaccauccuggagcucacggacgcgcuggcccuggggaugaugguccucaagaucgugcgcaacauggagaaguaccagcuggccgugaccaucauggccaucagcugcgucccgaacgccgugauccugcagaacgcguggaagguguccugcaccauccucgccgccgucagcgugagcccccugcugcucaccagcucccagcagaaggccgacuggaucccccuggcgcugacgaucaagggccucaaccccaccgccaucuuccugaccacccugagccggacguccaagaagcgcagcuggccgcucaacgaggccaucauggccgucggcaugguguccauccuggccagcagccugcucaagaacgacauccccaugaccgggccccugguggcgggcgggcugcucaccgucugcuacgugcugaccggccgguccgccgaccuggagcucgagcgcgccgccgacgugaagugggaggaccaggccgagaucagcggguccagccccauccuguccaucacgaucagcgaggacggcuccaugagcaucaagaacgaggaggaggagcagacccugaccauccucauccggaccggccugcuggucaucuccgggguguucccggugagcauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacagccagaucggcgccggcguguacaaggaggggacguuccacaccauguggcacgugacccggggcgccguccugaugcaccgcgggaagcggaucgagcccuccugggccgacgugaagaaggaccugaucagcuacggcgggggcuggaagcucgagggcgaguggaaggagggggaggaggugcagguccuggcccuggagcccggcaagaacccccgcgcggugcagaccaagcccgggaucuucaagacgaacaccggcaccaucggggccgugucccucgacuucagccccggcaccuccggcagccccaucgucgaccggaaggggaagguggugggccuguacgggaacggcgucgugacgcgcuccggcgccuacgugagcgccaucgcgcagaccgagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacgcugauccucgccccgacccgcgugguggcggccgagauggaggaggcccugcggggccugcccauccgcuaccagaccaccgccaucaagacggagcacaccgggcgggagaucgucgaccucaugugccacgccaccuucaccaugcgccugcugucccccgugcgggugcccaacuacaaccucaucaucauggacgaggcgcacuucacggacccggccagcaucgccgcccgcggcuacaucuccacccgggucgagaugggcgaggccgcggggaucuucaugaccgccacgccgcccggcagccgcgaccccuucccgcaguccaacgcccccaucauggacgaggagcgggagauccccgagcgcagcuggaacuccgggcacgagugggugacggacuucaagggcaagaccgugugguucguccccagcaucaaggccgggaacgacaucgcggccugccugcggaagaacggcaagaaggugauccagcugucccgcaagaccuucgacagcgaguacgugaagacccgggccaacgacugggacuucgucgugacgaccgacaucuccgagaugggcgccaacuucaaggccgagcgcgugaucgacccgcggcgcugcaugaagcccgucauccucaccgacggggaggagcgggugauccuggcgggccccaugcccgugacccacagcuccgccgcccagcgccgggggcgcaucggccgcaacccgaagaacgagaacgaccaguacaucuacaugggggagccccuggagaacgacgaggacugcgcccacuggaaggaggccaagaugcuccuggacaacaucaacacgcccgagggcaucauccccagcauguucgagccggagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggaccaaggagggggagcgcaagaagcugaagccccgguggcuggacgcccgcaucuacuccgacccgcucgcccugaaggaguucaaggaguucgccgcgggccgcaagagccugacccucaaccugaucacggagaugggccgccugcccaccuucaugacccagaaggcccggaacgcccucgacaaccuggccgugcugcacaccgccgaggccgggggccgcgccuacaaccacgcccucuccgagcugcccgagacgcuggagacccuccugcugcucacccugcuggccaccgucaccgggggcaucuuccucuuccugaugagcggcaaggggaucggcaagaugacgcuggggaugugcugcaucaucaccgccuccauccuccugugguacgcgcagauccagccccacuggaucgccgccagcaucauccuggaguucuuccucaucgugcugcugaucccggagcccgagaagcagcggacgccccaggacaaccagcucaccuacgucgugaucgccauccugacgguggucgccgcgaccauggccaacgagaugggcuuccuggagaagaccaagaaggaccucgggcugggcagcaucaccacgcaggaguccgagagcaacauccuggacaucgaccuccgccccgccuccgccuggacccuguacgccguggcgaccaccuucgugacgccgaugcugcggcacagcaucgagaacuccagcgucaacgugucccucaccgccaucgccaaccaggccaccgugcugaugggccuggggaagggcuggccccucagcaagauggacaucggggucccccugcuggcgaucggcugcuacucccaggugaaccccaucacccucacggccgcccugcugcuccugguggcccacuacgccaucaucgggccgggccugcaggcgaaggccacccgcgaggcccagaagcgggccgccgcgggcaucaugaagaaccccaccgucgacgggaucaccgugaucgaccucgagcccauccccuacgacccgaaguucgagaagcagcugggccaggugaugcugcucauccugugcgucacccagguccugaugaugcgcaccaccugggcccucugcgaggcccugacccuggccacggggcccaucagcacccucugggagggcaaccccgggcgguucuggaacaccaccaucgccguguccauggcgaacaucuuccgcggcagcuaccuggccggcgccgggcuccuguucuccaucaugaagaacacgaccaacacccgccggggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugacgaagggcgggccgggccacgaggagcccauccccaugagcaccuacggguggaaccucgugcgccugcagagcggcgucgacguguucuucacgccgcccgagaagugcgacacccugcucugcgacaucggggaguccagccccaaccccaccaucgaggccggccggacgcugcgcgugcugaaccucgucgagaacuggcugaacaacaacacccaguucugcaucaaggugcugaaccccuacaugcccuccgugaucgagaagauggaggcccuccagcggaaguacggcggggcgcugguccgcaacccccugagccggaacuccacccacgagauguacugggugagcaacgccaccggcaacaucguguccagcgucaacaugaucucccgcaugcugaucaaccgguucacgaugaagcacaagaaggccaccuacgagcccgacguggaccucgggagcggcacccgcaacaucgggaucgaguccgagaucccgaaccuggacaucaucggcaagcggaucgagaagaucaagcaggagcacgagaccagcuggcacuacgaccaggaccaccccuacaagacgugggccuaccacggcuccuacgagaccaagcagaccgggagcgccuccagcauggugaacggcgucgugcgccugcucaccaagcccugggacgugguccccauggugacgcagauggcgaugaccgacaccaccccguucgggcagcagcgcguguucaaggagaaggucgacacgcggacccaggagcccaaggagggcaccaagaagcugaugaagaucaccgccgaguggcuguggaaggagcucggcaagaagaagacgccccgcaugugcacccgggaggaguucacccgcaaggugcgguccaacgccgcccugggggccaucuucaccgacgagaacaaguggaaguccgcgcgcgaggccguggaggacggccgguucugggagcuggucgaccgcgagcggaaccuccaccuggaggggaagugcgagacgugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcaccgccucggcuacauccugcgggacgucgggaagaaggagggcggggccauguacgccgacgacaccgccggcugggacacccgcaucacccuggaggaccucaagaacgaggagauggugacgaaccacaugaagggggagcacaagaagcuggcggaggccaucuucaagcugaccuaccagaacaaggucgugcgggugcagcgccccaccccgcggggcaccgucauggacaucaucagccgccgggaccagcgcggcuccggccaggugggcacguacgggcucaacaccuucaccaacauggaggcccagcugauccgccagauggagggcgagggcaucuucaagagcauccagcaccugaccgccacggaggagaucgccgugcagaacuggcucgcgcgggucgggcgcgagcggcugucccgcauggccaucagcggcgacgacugcguggugaagcccaucgacgaccgguucgccuccgcccugaccgcccucaacgacauggggaagauccgcaaggacauccagcagugggagcccagccggggcuggaacgacuggacccagguccccuucugcucccaccacuuccacgagcuggugaugaaggacgggcgcgugcuggucgugccgugccggaaccaggacgagcucaucggccgcgcgcggaucagccagggcgccggguggucccugaaggagaccgccugccugggcaagagcuacgcccagauguggacccucauguacuuccaccgccgggaccugcgccuggccgcgaacgccaucugcuccgccgugcccagccacuggguccccacgucccggaccaccuggagcauccacgccaagcacgaguggaugaccacggaggacaugcucgcgguguggaaccgcguguggauccaggagaaccccuggauggaggacaagaccccggucgaguccugggaggaggugcccuaccuggggaagcgggaggaccaguggugcggcagccugaucgggcucaccagccgcgccaccugggccaagaacauccagacggccaucaaccaggugcggucccugaucggcaacgaggaguacaccgacuacaugcccagcaugaagcgcuuccgccgggaggaggaggaggccggcguccugugguga

SEQ ID NO: 9268 - RNA, 9876 nt, Artificial Sequence
  derived and/or modified CDS sequence (opt1) from DENV-2__EU482751__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcaccuacggguggaaccugguccgccuccagagcggcguggacguguucuucacgccgcccgagaagugcgacacccugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucacccgcaaggugcgguccaacgccgcccucggggccaucuucacggacgagaacaaguggaaguccgcgcgcgaggccgucgaggacggccgguucugggagcugguggaccgcgagcggaaccugcaccucgaggggaagugcgagaccugcguguacaacaugaugggcaagcgcgagaagaagcugggggaguucggcaaggccaagggcucccgggccaucugguacauguggcugggggcgcgcuuccucgaguucgaggcccugggcuuccugaacgaggaccacugguucagccgggggaacagccucuccggcgucgagggggagggccugcaccgccugggcuacauccuccgggacguggggaagaaggagggcggggccauguacgccgacgacaccgccggcugggacacccgcaucacgcuggaggaccugaagaacgaggagauggucaccaaccacaugaagggggagcacaagaagcucgcggaggccaucuucaagcugaccuaccagaacaagguggugcggguccagcgcccgacgccccggggcacggugauggacaucaucagccgccgggaccagcgcggcuccgggcaggucggcaccuacgggcugaacaccuucaccaacauggaggcccagcucauccgccagauggagggcgagggcaucuucaagagcauccagcaccugacggccaccgaggagaucgccguccagaacuggcuggcgcggguggggcgcgagcggcucucccgcauggccaucagcggcgacgacugcguggucaagcccaucgacgaccgguucgccuccgcccugaccgcccugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcgcggaucagccagggcgccggguggucccucaaggagacggccugccugggcaagagcuacgcccagauguggacccugauguacuuccaccgccgggaccuccgccuggccgcgaacgccaucugcuccgccgugcccagccacugggugcccaccucccggaccaccuggagcauccacgccaagcacgaguggaugacgaccgaggacaugcuggcggucuggaaccgcguguggauccaggagaacccguggauggaggacaagacccccguggaguccugggaggagguccccuaccucgggaagcgggaggaccaguggugcggcagccugaucgggcugaccagccgcgccacgugggccaagaacauccaggccgccaucaaccaggugcggucccucaucggcaacgaggaguacaccgacuacaugcccagcaugaagcgcuuccgccgggaggaggaggaggcgggcgugcugugguga

SEQ ID NO: 9269 - RNA, 9876 nt, Artificial Sequence
  derived and/or modified CDS sequence (opt1) from DENV-2__GQ868604__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgaccugugcgaggggaccaccguggucgugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcggggccagaucgacaacuucucccugggcgugcuggggauggcccucuuccuggaggagaugcugcgcacccggaucggcacgaagcacgcgauccuccugguggccgucagcuucgugacccugaucaccgggaacauguccuuccgcgaccucggccgcgugauggucauggugggggccaccaugacggacgacaucggcaugggcgugaccuaccuggcccugcucgccgcguucaagguccggcccaccuucgccgccgggcugcugcuccgcaagcugaccagcaaggagcugaugauggccacgaucggcaucgcccuccugucccagagcaccauccccgagaacauccuggagcucaccgacgcgcuggcccuggggaugauggugcucaagaucgugcggaacauggagaaguaccagcuggccgucaccaucauggccaucuccugcgugccgaacgccgugauccugcagaacgcguggaaggucagcugcacgauccucgccgccguguccgucagcccccugcugcucaccuccagccagcagaaggccgacuggaucccccuggcgcugaccaucaagggccucaaccccaccgccaucuuccugacgacccugucccgcaccagcaagaagcgguccuggccgcucaacgaggccaucauggccgugggcauggugagcauccuggccuccagccugcucaagaacgacauccccaugaccgggccccuggucgcgggcgggcugcucacggugugcuacgugcugaccggccgcagcgccgaccuggagcucgagcgggccgccgacgucaagugggaggaccaggccgagaucuccgggagcucccccauccugagcaucaccaucuccgaggacggcagcauguccaucaagaacgaggaggaggagcagacccugacgauccucauccgcaccggccugcuggugaucagcgggguguucccggucuccauccccaucaccgcggccgccugguaccucugggaggugaagaagcagcgggccggcgugcugugggacguccccagcccgccgcccguggagaaggccgagcuggaggacggggcguaccgcaucaagcagcggggcauccucggguacucccagaucggcgccggcguguacaaggaggggaccuuccacaccauguggcacgucacgcgcggcgccgugcugaugcaccgggggaagcgcaucgagcccagcugggccgacgugaagaaggaccugaucuccuacggcgggggcuggaagcucgagggcgaguggaaggagggggaggagguccaggugcuggcccuggagcccggcaagaacccccgggcggugcagaccaagcccgggaucuucaagaccaacaccggcacgaucggggccgucagccucgacuucucccccggcaccagcggcucccccaucguggaccgcaaggggaagguggucggccuguacgggaacggcguggugacccggagcggcgccuacgucuccgccaucgcgcagaccgagaaguccaucgaggacaaccccgagaucgaggacgacaucuuccgcaagaagcggcugacgaucauggaccuccaccccggggccggcaagaccaagcgcuaccugcccgccaucgugcgggaggccaucaagcgcgggcugcgcacccugauccucgccccgacccggguggucgcggccgagauggaggaggcccugcgcggccugcccauccgguaccagacgcccgccaucaagaccgagcacaccgggcgcgagaucguggaccucaugugccacgccaccuucacgaugcggcugcugagccccgugcgcgucccgaacuacaaccucaucaucauggacgaggcgcacuucaccgaccccgccuccaucgccgcccggggcuacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccugcgcaagaacggcaagaaggugauccagcugagccggaagaccuucgacuccgaguacgucaagacgcgcgccaacgacugggacuucguggugaccaccgacaucagcgagaugggcgccaacuucaaggccgagcgggucaucgacccccgccggugcaugaagcccgugauccucaccgacggggaggagcgcgugauccuggcgggccccaugccggucacgcacuccagcgccgcccagcggcgcgggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccggaagaccuucguggaccucaugcgccggggcgaccugcccgucuggcuggccuacaagguggccgccgaggggaucaacuacgcggaccgcaaguggugcuucgacggcaucaagaacaaccagauccucgaggagaacauggagguggagaucuggaccaaggagggggagcggaagaagcugaagccgcgcuggcuggacgcccggaucuacagcgacccccucgcccugaaggaguucaaggaguucgccgcgggccgcaagucccugacgcucaaccugaucaccgagaugggccggcugcccaccuucaugacccagaaggcccgcaacgcccucgacaaccuggccguccugcacacggccgaggccgggggccgggccuacaaccacgcccucagcgagcugcccgagacccuggagacccuccugcugcucacccugcuggccacggugaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucgggcugggcagcaucacgacccaggagagcgaguccaacauccuggacaucgaccuccggccggccagcgccuggacccuguacgccguggcgaccacguucgucacccccaugcugcgccacuccaucgagaacagcuccgugaacgugagccucaccgccaucgccaaccaggccaccguccugaugggccuggggaagggcuggccccucuccaagauggacaucggggugccccugcuggcgaucggcugcuacagccaggugaacccgaucacgcucaccgccgcccugcugcuccuggucgcccacuacgccaucaucgggcccggccugcaggcgaaggccacccgggaggcccagaagcgcgccgccgcgggcaucaugaagaaccccaccguggacgggaucacggugaucgaccucgagcccaucccguacgaccccaaguucgagaagcagcugggccaggucaugcugcucauccugugcgugacccaggugcugaugaugcggaccaccugggcccucugcgaggcccugacgcuggccaccgggcccaucuccacccucugggagggcaaccccgggcgcuucuggaacaccacgaucgccgucagcauggcgaacaucuuccgcggcuccuaccuggccggcgccgggcuccuguucagcaucaugaagaacaccaccuccacccggcgcggcacggggaacaucggcgagacccugggcgagaaguggaagucccggcugaacgcccucgggaaguccgaguuccagaucuacaagaaguccggcauccaggagguggaccgcacccuggcgaaggaggggaucaagcggggcgagaccgaccaccacgccgugucccgcgggagcgccaagcugcggugguucgucgagcgcaacauggugacgccggagggcaagguggucgaccucggcugcgggcggggcgggugguccuacuacugcggcgggcugaagaacgugcgcgaggugaagggccugaccaagggcgggcccggccacgaggagcccauccccaugagcaccuacggguggaaccucguccggcugcagagcggcguggacguguucuucaccccgcccgagaagugcgacacgcugcucugcgacaucggggaguccagccccaaccccaccaucgaggccggccgcacccugcggguccugaaccucguggagaacuggcugaacaacaacacccaguucugcaucaaggugcugaacccguacaugcccuccgucaucgagaagauggaggcccuccagcgccaguacggcggggcgcuggugcggaacccccugagccgcaacuccacccacgagauguacugggugagcaacgccacgggcaacaucgucuccagcgugaacaugaucucccggaugcugaucaaccgcuucaccaugaagcacaagaaggccaccuacgagccggacguggaccucgggagcggcacccggaacaucgggaucgaguccgagauccccaaccuggacaucaucggcaagcgcaucgagaagaucaagcaggagcacgagaucagcuggcacuacgaccaggaccaccccuacaagacgugggccuaccacggcuccuacgagaccaagcagaccgggagcgccuccagcauggucaacggcguggugcgccugcucaccaagcccugggacgucgugccgauggugacgcagauggcgaugaccgacaccacccccuucgggcagcagcgggucuucaaggagaagguggacacgcgcacccaggagcccaaggagggcaccaagaagcugaugaagaucaccgccgaguggcuguggaaggagcucggcaagaagaagacgccccggaugugcacccgcgaggaguucaccaagaaggugcgguccaacgccgcccugggggccaucuucaccgacgagaacaaguggaaguccgcgcgcgaggccgucgaggacggccgguucugggagcugguggaccgcgagcggaaccuccaccuggaggggaagugcgagacgugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcgucgagggggagggccugcaccgccucggcuacauccugcgggacguggggaagaaggagggcggggccauguacgccgacgacaccgccggcugggacacccgcaucacccuggaggaccucaagaacgaggagauggucacgaaccacaugaagggggagcacaagaagcuggcggaggccaucuucaagcugaccuaccagaacaagguggugcggguccagcgcccgacgccccggggcaccgugauggacaucaucagccgccgggaccagcgcggcuccgggcaggucggcacguacgggcucaacaccuucaccaacauggaggcccagcugauccgccagauggagggcgagggcaucuucaagagcauccagcaccugaccgccacggaggagaucgccguccagaacuggcucgcgcggguggggcgcgagcggcugucccgcauggccaucagcggcgacgacugcguggucaagcccaucgacgaccgguucgccuccgcccugaccgcccucaacgacauggggaaggugcgcaaggacauccagcagugggagcccagccggggcuggaacgacuggacccaggugccguucugcucccaccacuuccacgagcuggucaugaaggacgggcgcgugcuggugguccccugccggaaccaggacgagcucaucggccgcgcgcggaucagccagggcgccggguggucccugaaggagaccgccugccugggcaagagcuacgcccagauguggacgcucauguacuuccaccgccgggaccugcgccuggccgcgaacgccaucugcuccgccgugcccagccacugggugcccaccucccggaccaccuggagcauccacgccaagcacgaguggaugaccacggaggacaugcucgcggucuggaaccgcguguggauccaggagaacccguggauggaggacaagacccccguggaguccugggaggagguccccuaccuggggaagcgggaggaccaguggugcggcagccugaucgggcucaccagccgcgccaccugggccaagaacauccagacggccaucaaccaggugcggucccugaucggcaacgaggaguacaccgacuacaugcccagcaugaagcgcuuccgccgggaggaggaggaggccggcgugcugugguga

SEQ ID NO: 9270 - RNA, 9876 nt, Artificial Sequence
  derived and/or modified CDS sequence (opt1) from DENV-2__EU482752__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaacauccuggagcucaccgacgcgcuggcccuggggaugaugguccucaagaucgugcggaacauggagaaguaccagcuggccgugaccaucauggccaucuccugcgucccgaacgccgugauccugcagaacgcguggaaggugagcugcacgauccucgccgccgucuccgugagcccccugcugcucaccuccagccagcagaaggccgacuggaucccccuggcgcugaccaucaagggccucaaccccaccgccaucuuccugacgacccugucccgcaccagcaagaagcgguccuggccgcucaacgaggccaucauggccgucggcauggugagcauccuggccuccagccugcucaagaacgacauccccaugaccgggccccugguggcgggcgggcugcucacggucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacccugacgauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacaccauguggcacgugacgcgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacaccggcacgaucggggccgugagccucgacuucucccccggcaccagcggcucccccaucgucgaccgcaaggggaagguggugggccuguacgggaacggcgucgugacccggagcggcgccuacguguccgccaucgcgcagaccgagaaguccaucgaggacaaccccgagaucgaggacgacaucuuccgcaagaagcggcugacgaucauggaccuccaccccggggccggcaagaccaagcgcuaccugcccgccaucguccgggaggccaucaagcgcgggcugcgcacccugauccucgccccgacccgggugguggcggccgagauggaggaggcccugcgcggccugcccauccgguaccagacgaccgccaucaagaccgagcacaccgggcgcgagaucgucgaccucaugugccacgccacguucaccaugcggcugcugagccccgugcgcgugcccaacuacaaccucaucaucauggacgaggcgcacuucaccgacccggccuccaucgccgcccggggcuacaucagcacccgcgucgagaugggcgaggccgcggggaucuucaugacggccacgccgcccggcucccgggaccccuucccgcagagcaacgcccccaucauggacgaggagcgcgagauccccgagcgguccuggaacagcgggcacgagugggugaccgacuucaagggcaagaccgugugguucguccccuccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccgcgccggugcaugaagcccgucauccucacggacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggacgaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccggcccgccagcgccuggacccuguacgccguggcgacgaccuucgugaccccgaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacccgggaggcccagaagcgcgccgccgcgggcaucaugaagaaccccacggucgacgggaucaccgugaucgaccucgagcccauccccuacgacccgaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggaggucgaccgcacccuggcgaaggaggggaucaagcggggcgagacggaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccaccuacggguggaaccucgugcggcugcagagcggcgucgacguguucuucacgcccccggagaagugcgacacccugcucugcgacaucggggagagcucccccaaccccaccaucgaggccggccgcacccugcgggugcugaaccucgucgagaacuggcugaacaacaacacccaguucugcaucaaggugcugaaccccuacaugccgagcgugaucgagaagauggaggcccuccagcgcaaguacggcggggcgcugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagcccgacguggaccucggguccggcacgcggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacgugguccccauggugacccagauggcgaugaccgacacgaccccguucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgccggcugggacacgcggaucacccuggaggaccucaagaacgaggagauggugaccaaccacaugaagggggagcacaagaagcuggcggaggccaucuucaagcugaccuaccagaacaaggucgugcgcgugcagcggcccacgccgcgcggcaccgucauggacaucaucucccggcgcgaccagcgcggcagcgggcaggucggcaccuacgggcucaacaccuucacgaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugaccgcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcaccacgugguccauccacgccaagcacgaguggaugaccaccgaggacaugcucgcgguguggaaccgggucuggauccaggagaaccccuggauggaggacaagaccccgguggagagcugggaggaggugcccuaccuggggaagcgcgaggaccaguggugcggcucccugaucgggcucacgagccgggccaccugggccaagaacauccagaccgccaucaaccagguccgcagccugaucggcaacgaggaguacaccgacuacaugcccuccaugaagcgcuuccggcgcgaggaggaggaggccggcgugcugugguga

SEQ ID NO: 9271 - RNA, 9876 nt, Artificial Sequence
  derived and/or modified CDS sequence (opt1) from DENV-2__EU482753__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcuccaugaucgggcugaccagccgggccaccugggccaagaacauccagaccgccaucaaccagguccgcagccucaucggcaacgaggaguacacggacuacaugcccuccaugaagcgcuuccggcgcgaggaggaggaggccggcgugcugugguga

SEQ ID NO: 9272 - RNA, 9876 nt, Artificial Sequence
  derived and/or modified CDS sequence (opt1) from DENV-2__EU482680__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccgucguggugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccggaucggcacgaagcacgcgauccuccuggucgccgugagcuucgugacccugaucaccgggaacauguccuuccgcgaccucggccgcgucauggugauggugggggccaccaugacggacgacaucggcaccggcgucaccuaccuggcccugcucgccgcguucaaggugcggcccaccuucgccgccgggcugcugcuccgcaagcugacgagcaaggagcugaugauggccaccaucggcaucgcccuccugucccagagcaccauccccgagaccauccuggagcucacggacgcgcuggcccuggggaugauggugcucaagaucguccggaacauggagaaguaccagcuggccgugaccaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugacgaucaagggccucaaccccaccgccaucuuccugaccacccugucccgcacgagcaagaagcgguccuggccgcucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgacgugaagugggaggaccaggccgagaucuccgggagcucccccauccugagcaucacgaucuccgaggacggcagcauguccaucaagaacgaggaggaggagcagacccugaccauccucauccgcaccggccugcuggugaucagcggggucuucccgguguccauccccaucaccgcggccgccugguaccucugggaggugaagaagcagcgggccggcguccugugggacgugcccagcccgccgcccguggagaaggccgagcuggaggacggggcguaccgcaucaagcagcggggcauccucggguacucccagaucggcgccggcgucuacaaggaggggacguuccacaccauguggcacgugacccgcggcgccgugcugaugcaccgggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggcgguccagaccaagcccgggaucuucaagacgaacaccggcaccaucggggccgugagccucgacuucucccccggcaccagcggcucccccaucguggaccgcaaggggaaggucgugggccuguacgggaacggcguggucacgcggagcggcgccuacguguccgccaucgcgcagaccgagaaguccaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcgcacgcugauccucgccccgacccgggucguggcggccgagauggaggaggcccugcgcggccugcccauccgguaccagaccaccgccaucaagacggagcacaccgggcgcgagaucguggaccucaugugccacgccaccuucaccaugcggcugcugagccccguccgcgugcccaacuacaaccucaucaucauggacgaggcgcacuucacggacccggccuccaucgccgcccggggcuacaucagcacccgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggucacggacuucaagggcaagaccgugugguucgugcccuccaucaaggccgggaacgacaucgcggccugccugcgcaagaacggcaagaaggucauccagcugagccggaagaccuucgacuccgaguacgugaagacccgcgccaacgacugggacuucguggucacgaccgacaucagcgagaugggcgccaacuucaaggccgagcgggugaucgacccgcgccggugcaugaagcccgugauccucaccgacggggaggagcgcgucauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacgcccgagggcaucauccccuccauguucgagccggagcgcgagaagguggacgcgaucgacggcgaguaccggcugcgcggggaggcccggaagaccuucgucgaccucaugcgccggggcgaccugcccguguggcuggccuacaagguggccgccgaggggaucaacuacgcggaccgcaaguggugcuucgacggcaucaagaacaaccagauccucgaggagaacauggaggucgagaucuggaccaaggagggggagcggaagaagcugaagccccgcuggcuggacgcccggaucuacagcgacccgcucgcccugaaggaguucaaggaguucgccgcgggccgcaagucccugacccucaaccugaucacggagaugggccggcugcccaccuucaugacccagaaggcccgcaacgcccucgacaaccuggccgugcugcacaccgccgaggccgggggccgggccuacaaccacgcccucagcgagcugcccgagacgcuggagacccuccugcugcucacccugcuggccaccgugaccgggggcaucuuccucuuccugauguccggcaaggggaucggcaagaugacgcuggggaugugcugcaucaucaccgccagcauccuccugugguacgcgcagauccagccccacuggaucgccgccuccaucauccuggaguucuuccucaucguccugcugaucccggagcccgagaagcagcgcacgccccaggacaaccagcucaccuacguggucaucgccauccugacggugguggccgcgaccauggccaacgagaugggcuuccuggagaagaccaagaaggaccucgggcugggcagcaucaccacgcaggagagcgaguccaacauccuggacaucgaccuccggcccgccagcgccuggacccuguacgccgucgcgaccaccuucgugacgccgaugcugcgccacuccaucgagaacagcuccgugaacgucagccucaccgccaucgccaaccaggccaccgugcugaugggccuggggaagggcuggccccucuccaagauggacaucggggugccccugcuggcgaucggcugcuacagccaggucaaccccaucacccucacggccgcccugcugcuccugguggcccacuacgccaucaucgggccgggccugcaggcgaaggccacccgggaggcccagaagcgcgccgccgcgggcaucaugaagaaccccaccguggacgggaucaccgucaucgaccucgagcccauccccuacgacccgaaguucgagaagcagcugggccaggugaugcugcucauccugugcgugacgcagguccugaugaugcggaccaccugggcccucugcgaggcccugacccuggccacggggcccaucuccacccucugggagggcaaccccgggcgcuucuggaacaccaccaucgccgugagcauggcgaacaucuuccgcggcuccuaccuggccggcgccgggcuccuguucagcaucaugaagaacacgaccaacacccggcgcggcaccgggaacaucggcgagacgcugggcgagaaguggaagucccggcugaacgcccucggcaagagcgaguuccagaucuacaagaaguccggcauccaggagguggaccgcacccuggcgaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugacgaagggcgggccgggccacgaggagcccauccccauguccaccuacggguggaaccucgugcggcugcagagcggcguggacgucuucuucacgccgcccgagaagugcgacacccugcucugcgacaucggggagagcucccccaaccccaccaucgaggccggccgcacgcugcgggugcugaaccucguggagaacuggcugaacaacaacacccaguucugcaucaagguccugaaccccuacaugcccagcgugaucgagaagauggaggcccuccagcgcaaguacggcggggcgcuggugcggaacccccugucccgcaacagcacccacgagauguacugggucuccaacgccaccggcaacaucgugagcuccgugaacaugaucagccggaugcugaucaaccgcuucacgaugaagcacaagaaggccaccuacgagcccgacgucgaccucggguccggcacccggaacaucgggaucgagagcgagaagccgaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgugguccgccugcucaccaagcccugggacguggugcccauggucacgcagauggcgaugaccgacaccaccccguucgggcagcagcggguguucaaggagaagguggacacgcgcacccaggagcccaaggagggcaccaagaagcugaugaagaucaccgccgaguggcuguggaaggagcucggcaagaagaagacgccccggaugugcacccgcgaggaguucacccggaagguccgcagcaacgccgcccugggggccaucuucaccgacgagaacaaguggaaguccgcgcgggaggccguggaggacggccgcuucugggagcugguggaccgggagcgcaaccuccaccuggaggggaagugcgagacgugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacguggggaagaaggagggcggggccauguacgccgacgacaccgccggcugggacacccggaucacccuggaggaccucaagaacgaggagauggucacgaaccacaugaagggggagcacaagaagcuggcggaggccaucuucaagcugaccuaccagaacaaggugguccgcgugcagcggcccaccccgcgcggcaccgugauggacaucaucucccggcgcgaccagcgcggcagcgggcaggucggcacguacgggcucaacaccuucaccaacauggaggcccagcugauccggcagauggagggcgagggcaucuucaaguccauccagcaccugaccgccacggaggagaucgccgugcagaacuggcucgcgcgcguggggcgggagcgccugagccggauggccaucuccggcgacgacugcgucgugaagcccaucgacgaccgcuucgccagcgcccugaccgcccucaacgacauggggaaggugcggaaggacauccagcagugggagcccucccgcggcuggaacgacuggacccagguccccuucugcagccaccacuuccacgagcuggugaugaaggacgggcgggugcuggucgugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugcccucccacuggguccccacgagccgcaccaccugguccauccacgccaagcacgaguggaugaccacggaggacaugcucgcgguguggaaccggguguggauccaggagaaccccuggauggaggacaagaccccggucgagagcugggaggaggugcccuaccuggggaagcgcgaggaccaguggugcggcucccugaucgggcucaccagccgggccaccugggccaagaacauccagacggccaucaaccaggugcgcagccugaucggcaacgaggaguacaccgacuacaugcccuccaugaagcgcuuccggcgcgaggaggaggaggccggcguccugugguga

SEQ ID NO: 9273 - RNA, 9876 nt, Artificial Sequence
  derived and/or modified CDS sequence (opt1) from DENV-2__EU482754__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacauccacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccgucguggugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccggaucggcacgaagcacgcgauccuccuggucgccgugagcuucgugacccugaucaccgggaacauguccuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugauggugcucaagaucguccggaacauggagaaguaccagcuggccgugacgaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgugggcauggucagcauccuggccuccagccugcucaagaacgacauccccaugacggggccccugguggcgggcgggcugcucaccgugugcuacguccugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggugaucagcggggucuucccgguguccauccccaucaccgcggccgccugguaccucugggaggugaagaagcagcgggccggcguccugugggacgugcccagcccgccgcccguggagaaggccgagcuggaggacggggcguaccgcaucaagcagcggggcauccucggguacucccagaucggcgccggcgucuacaaggaggggaccuuccacacgauguggcacgugacccgcggcgccgugcugaugcaccgggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggcgguccagaccaagcccgggaucuucaagaccaacacgggcaccaucggggccgugagccucgacuucucccccggcaccagcggcucccccaucguggaccgcaaggggaaggucgugggccuguacgggaacggcguggucacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcgcacccugauccucgccccgacgcgggucguggcggccgagauggaggaggcccugcgcggccugcccauccgguaccagaccaccgccaucaagaccgagcacacggggcgcgagaucguggaccucaugugccacgccaccuucaccaugcggcugcugagccccguccgcgugcccaacuacaaccucaucaucauggacgaggcgcacuucaccgacccggccuccaucgccgcccggggcuacaucagcacgcgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggucaccgacuucaagggcaagacggugugguucgugcccuccaucaaggccgggaacgacaucgcggccugccugcgcaagaacggcaagaaggucauccagcugagccggaagaccuucgacuccgaguacgugaagacccgcgccaacgacugggacuucguggucaccacggacaucagcgagaugggcgccaacuucaaggccgagcgggugaucgacccgcgccggugcaugaagcccgugauccucaccgacggggaggagcgcgucauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaagguggacgcgaucgacggcgaguaccggcugcgcggggaggcccggaagacguucgucgaccucaugcgccggggcgaccugcccguguggcuggccuacaagguggccgccgaggggaucaacuacgcggaccgcaaguggugcuucgacggcaucaagaacaaccagauccucgaggagaacauggaggucgagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucguccugcugaucccggagcccgagaagcagcgcacgccccaggacaaccagcucaccuacguggucaucgccauccugaccgugguggccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccgucgcgaccaccuucgugaccccgaugcugcgccacuccaucgagaacagcuccgugaacgucagccucacggccaucgccaaccaggccaccgugcugaugggccuggggaagggcuggccccucuccaagauggacaucggggugccccugcuggcgaucggcugcuacagccaggucaaccccaucacccucaccgccgcccugcugcuccugguggcccacuacgccaucaucgggccgggccugcaggcgaaggccacgcgggaggcccagaagcgcgccgccgcgggcaucaugaagaaccccaccguggacgggaucaccgucaucgaccucgagcccauccccuacgacccgaaguucgagaagcagcugggccaggugaugcugcucauccugugcgugacccagguccugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggagguggaccgcacgcuggcgaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggccgggccacgaggagcccauccccauguccacguacggguggaaccucgugcggcugcagagcggcguggacgucuucuucacgccgcccgagaagugcgacacccugcucugcgacaucggggagagcucccccaaccccaccaucgaggccggccgcacccugcgggugcugaaccucguggagaacuggcugaacaacaacacgcaguucugcaucaagguccugaaccccuacaugcccagcgugaucgagaagauggaggcccuccagcgcaaguacggcggggcgcuggugcggaacccccugucccgcaacagcacccacgagauguacugggucuccaacgccaccggcaacaucgugagcuccgugaacaugaucagccggaugcugaucaaccgcuucaccaugaagcacaagaaggccacguacgagcccgacgucgaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccgccugcucaccaagcccugggacguggugcccauggucacccagauggcgaugacggacaccaccccguucgggcagcagcggguguucaaggagaagguggacacccgcacgcaggagcccaaggagggcaccaagaagcugaugaagaucaccgccgaguggcuguggaaggagcucggcaagaagaagacgccccggaugugcacgcgcgaggaguucacccggaagguccgcagcaacgccgcccugggggccaucuucaccgacgagaacaaguggaaguccgcgcgggaggccguggaggacggccgcuucugggagcugguggaccgggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacguggggaagaaggagggcggggccauguacgccgacgacacggccggcugggacacccggaucacccuggaggaccucaagaacgaggagauggucaccaaccacaugaagggggagcacaagaagcuggcggaggccaucuucaagcugacguaccagaacaaggugguccgcgugcagcggcccaccccgcgcggcaccgugauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcguggggcgggagcgccugagccggauggccaucuccggcgacgacugcgucgugaagcccaucgacgaccgcuucgccagcgcccugacggcccucaacgacauggggaaggugcggaaggacauccagcagugggagcccucccgcggcuggaacgacuggacccagguccccuucugcagccaccacuuccacgagcuggugaugaaggacgggcgggugcuggucgugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugcccucccacuggguccccaccagccgcacgaccugguccauccacgccaagcacgaguggaugaccaccgaggacaugcucgcgguguggaaccggguguggauccaggagaaccccuggauggaggacaagacgccggucgagagcugggaggaggugcccuaccuggggaagcgcgaggaccaguggugcggcucccugaucgggcucaccagccgggccaccugggccaagaacauccagaccgccaucaaccaggugcgcagccugaucggcaacgaggaguacacggacuacaugcccuccaugaagcgcuuccggcgcgaggaggaggaggccggcguccugugguga

SEQ ID NO: 9274 - RNA, 9876 nt, Artificial Sequence
  derived and/or modified CDS sequence (opt1) from DENV-2__FJ478455__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccguggagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggccgugcacgcggacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgccgggcccuggcaccucggcaagcuggagauggacuucgacuucugcgaggggaccaccgucguggugacggaggacugcggcaaccggggccccagccugcgcaccaccaccgcgagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcaucggcacgaagcacgccauccugcucgucgcggugagcuucgugacccugaucaccgggaacauguccuuccgggaccugggccgcgucauggugauggugggggccaccaugacggacgacaucggcaugggcgucaccuaccucgcccugcuggccgccuucaaggugcgccccaccuucgcggccgggcuccugcugcggaagcucaccagcaaggagcugaugauggccacgaucggcaucgcccugcucucccagagcaccauccccgagaccauccuggagcugaccgacgcccucgcgcuggggaugauggugcugaagaucguccgcaacauggagaaguaccagcucgccgugacgaucauggccaucuccugcgugccgaacgccgucauccugcagaacgccuggaaggugagcugcaccauccuggcggccgucuccgugagcccccuccugcugaccuccagccagcagaaggccgacuggaucccccucgcccugaccaucaagggccugaaccccacggcgaucuuccucaccacccugucccggaccagcaagaagcgcuccuggccgcugaacgaggccaucauggccgugggcauggucagcauccucgccuccagccugcugaagaacgacauccccaugacggggccccucguggccggcgggcugcugaccgugugcuacguccucaccggccggagcgcggaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcggggucuucccgguguccauccccaucaccgccgcggccugguaccugugggaggugaagaagcagcgcgccggcguccucugggacgugcccagcccgccgcccguggagaaggccgagcuggaggacggggccuaccggaucaagcagcgcggcauccugggguacucccagaucggcgcgggcgucuacaaggaggggaccuuccacacgauguggcacgugacccggggcgccgugcucaugcaccgcgggaagcggaucgagcccagcugggccgacgucaagaaggaccugaucuccuacggcgggggcuggaagcuggagggcgaguggaaggagggggaggagguccaggugcucgcccuggagcccggcaagaacccccgcgccguccagaccaagcccgggaucuucaagaccaacacgggcaccaucggggcggugagccuggacuucucccccggcaccagcggcucccccaucguggaccggaaggggaaggucgugggccucuacgggaacggcguggucacccgcagcggcgccuacguguccgccaucgcccagacggagaaguccaucgaggacaaccccgagaucgaggacgacaucuuccggaagaagcgccugaccaucauggaccugcaccccggggcgggcaagaccaagcgguaccuccccgccaucgugcgcgaggccaucaagcgggggcugcgcacccugauccuggccccgacgcgcgucguggccgcggagauggaggaggcccuccggggccugcccauccgcuaccagacccccgccaucaagaccgagcacaccgggcgggagaucguggaccugaugugccacgccacguucaccaugcgccuccugagccccguccgggugccgaacuacaaccugaucaucauggacgaggcccacuucaccgaccccgcguccaucgccgcccgcggcuacaucagcacccggguggagaugggcgaggccgccgggaucuucaugacggcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgccgcgugccuccggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccugacggacggggaggagcgggucauccucgccggccccaugccggugacccacuccagcgcggcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcgcgcaagaccuucgucgaccugaugcggcgcggcgaccuccccguguggcuggccuacaagguggccgccgaggggaucaacuacgccgaccggaaguggugcuucgacggcaucaagaacaaccagauccuggaggagaacauggaggucgagaucuggacgaaggagggggagcgcaagaagcucaagccgcgguggcuggacgcgcgcaucuacagcgacccccuggcccucaaggaguucaaggaguucgccgccggccggaagucccugacccugaaccucaucaccgagaugggccgccugcccaccuucaugacgcagaaggcgcggaacgcccuggacaaccucgccgugcugcacaccgccgaggccgggggccgcgcguacaaccacgcccugagcgagcuccccgagacccuggagacccugcuccugcugacgcuccuggccaccgucaccgggggcaucuuccuguuccucauguccggcaaggggaucggcaagaugacccuggggaugugcugcaucaucaccgccagcauccugcucugguacgcccagauccagccgcacuggaucgcggccuccaucauccuggaguucuuccugaucgugcuccugauccccgagcccgagaagcagcggacgccccaggacaaccagcugaccuacguggucaucgccauccucaccgugguggccgccaccauggcgaacgagaugggcuuccuggagaagacgaagaaggaccuggggcucggcagcaucaccacccaggagagcgaguccaacauccuggacaucgaccugcgcccggccagcgccuggacccucuacgccgucgccacgaccuucgugacccccaugcugcggcacuccaucgagaacagcuccgugaacgucagccugaccgcgaucgccaaccaggccacggugcucaugggccuggggaagggcuggccccuguccaagauggacaucggggugccccuccuggccaucggcugcuacagccaggucaacccgaucacccugaccgcggcccuccugcugcucguggcccacuacgccaucaucgggcccggccugcaggccaaggcgacccgcgaggcccagaagcgggccgccgccggcaucaugaagaaccccacgguggacgggaucaccgucaucgaccuggagcccaucccguacgaccccaaguucgagaagcagcucggccaggugaugcugcugauccucugcgugacccagguccugaugaugcgcaccacgugggcgcugugcgaggcccucacccuggccaccgggcccaucuccacccugugggagggcaaccccgggcgguucuggaacacgaccaucgccgugagcauggccaacaucuuccgcggcuccuaccucgcgggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgccaaggaggggaucaagcgcggcgagacggaccaccacgcggucucccgggggagcgccaagcugcgcugguucguggagcggaacauggugaccccggagggcaaggucguggaccugggcugcgggcgcggcgggugguccuacuacugcggcgggcucaagaacgugcgggaggucaagggccugaccaagggcgggcccggccacgaggagcccauccccaugagcaccuacggguggaaccuggugcgccuccagagcggcguggacgucuucuucacgccgcccgagaagugcgacacccugcugugcgacaucggggaguccagccccaaccccaccaucgaggccggccggacccuccgcgugcugaaccugguggagaacuggcucaacaacaacacccaguucugcaucaagguccugaacccguacaugcccuccgugaucgagaagauggaggcccugcagcggcaguacggcggggcccucgugcgcaacccccugagccggaacuccacgcacgagauguacugggucagcaacgcgaccggcaacaucguguccagcgugaacaugaucucccgcaugcugaucaaccgguucaccaugaagcacaagaaggccaccuacgagccggacgucgaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggugaacggcgugguccgccugcugacgaagcccugggacguggugccgauggucacccagauggccaugaccgacaccacgcccuucgggcagcagcgcguguucaaggagaagguggacacccggacccaggagcccaaggagggcaccaagaagcucaugaagaucacggcggaguggcuguggaaggagcugggcaagaagaagacgccccgcaugugcacccgggaggaguucacccgcaagguccgguccaacgccgcccucggggccaucuucacggacgagaacaaguggaaguccgcccgcgaggcgguggaggacggccgguucugggagcugguggaccgcgagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggggaacagccucuccggcguggagggggagggccugcaccgccugggcuacauccuccgggacgucgggaagaaggagggcggggccauguacgccgacgacaccgccggcugggacacccgcaucacgcuggaggaccugaagaacgaggagauggugaccaaccacaugaagggggagcacaagaagcucgccgaggcgaucuucaagcugaccuaccagaacaaggugguccgggugcagcgcccgacgccccggggcacggugauggacaucaucagccgccgggaccagcgcggcuccgggcaggucggcaccuacgggcugaacaccuucaccaacauggaggcccagcucauccgccagauggagggcgagggcaucuucaagagcauccagcaccugacggccaccgaggagaucgccgugcagaacuggcuggcccggguggggcgcgagcggcucucccgcauggcgaucagcggcgacgacugcgucgugaagcccaucgacgaccgguucgccuccgcccugaccgcccugaacgacauggggaaggugcgcaaggacauccagcagugggagcccagccggggcuggaacgacuggacccaggucccguucugcucccaccacuuccacgagcucgugaugaaggacgggcgcgugcuggucgugcccugccggaaccaggacgagcugaucggccgcgcccggaucagccagggcgcgggguggucccucaaggagacggccugccugggcaagagcuacgcccagauguggacccugauguacuuccaccgccgggaccuccgccuggccgccaacgcgaucugcuccgccgugcccagccacuggguccccaccucccggaccaccuggagcauccacgccaagcacgaguggaugacgaccgaggacaugcuggccguguggaaccgcguguggauccaggagaacccguggauggaggacaagacccccgucgaguccugggaggaggugcccuaccucgggaagcgggaggaccaguggugcggcagccugaucgggcugaccagccgcgcgacgugggccaagaacauccaggccgccaucaaccaggugcggucccucaucggcaacgaggaguacaccgacuacaugcccagcaugaagcgcuuccgccgggaggaggaggaggccggcguccugugguga

SEQ ID NO: 9275 - RNA, 9876 nt, Artificial Sequence
  derived and/or modified CDS sequence (opt1) from DENV-2__EU482756__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaaguacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcucccugaucgggcucaccagccgggccaccugggccaagaacauccagaccgccaucaaccagguccgcagccugaucggcaacgaggaguacacggacuacaugcccuccaugaagcgcuuccggcgcgaggaggaggaggccggcgugcugugguga

SEQ ID NO: 9276 - RNA, 9876 nt, Artificial Sequence
  derived and/or modified CDS sequence (opt1) from DENV-2__EU482757__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcaucggcacgaagcacgcgauccuccugguggccgugagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccgucggcauggugagcauccuggccuccagccugcucaagaacgacauccccaugacggggccccugguggcgggcgggcugcucaccgucugcuacgugcugaccggccggagcgccgaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgccaucgcgcagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgccccgacgcgcgugguggcggccgagauggaggaggcccugcggggccugcccauccgcuaccagacccccgccaucaagaccgagcacaccgggcgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagaccuucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgccgaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgugacccccaugcugcggcacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgccgugagcauggcgaacaucuuccgcggcuccuaccuggccggcgccgggcuccuguucagcaucaugaagaacaccaccuccacgcgccggggcaccgggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagacggaccaccacgccgugucccgggggagcgccaagcugcgcugguucguggagcggaacauggucaccccggagggcaaggugguggaccucggcugcgggcgcggcgggugguccuacuacugcggcgggcugaagaacguccgggaggugaagggccugaccaagggcgggcccggccacgaggagcccauccccaugagcaccuacggguggaaccucgugcgccugcagagcggcgucgacguguucuucacgccgcccgagaagugcgacacccugcucugcgacaucggggaguccagccccaaccccaccaucgaggccggccggacccugcgcgugcugaaccucgucgagaacuggcugaacaacaacacccaguucugcaucaaggugcugaacccguacaugcccuccgugaucgagaagauggaggcccuccagcggaaguacggcggggcgcugguccgcaacccccugagccggaacuccacgcacgagauguacugggugagcaacgccaccggcaacaucguguccagcgucaacaugaucucccgcaugcugaucaaccgguucaccaugaagcacaagaaggccaccuacgagccggacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacguggucccgauggugacccagauggcgaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcgguccaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcaccgccucggcuacauccugcgggacgucagcaagaaggagggcggcgccauguacgccgacgacaccgccgggugggacacgcgcaucacccuggaggaccucaagaacgaggagauggugaccaaccacaugaagggcgagcacaagaagcuggcggaggccaucuucaagcugaccuaccagaacaaggucgugcgggugcagcgcccgacgccccgggggaccgucauggacaucaucucccgccgggaccagcgcggcagcggccagguggggaccuacggccucaacaccuucacgaacauggaggcccagcugauccgccagauggagggggagggcaucuucaaguccauccagcaccugaccgccaccgaggagaucgugguccagaacuggcucgcccgggugggccgcgagcggcugagccgcauggcgaucuccggggacgacugcguggucaagcccaucgacgaccgguucgccagcgcccugaccgcccucaacgacaugggcaaggugcgcaaggacauccagcagugggagcccucccggggguggaacgacuggacccaggucccguucugcagccaccacuuccacgagcuggucaugaaggacggccgcgugcuggugguccccugccggaaccaggacgagcucaucgggcgcgcccggaucucccagggcgcgggcuggagccugaaggagaccgccugccuggggaaguccuacgcccagauguggacccucauguacuuccaccgccgggaccugcgccuggccgccaacgcgaucugcagcgccgugcccucccacugggugcccaccagccggaccacgugguccauccacgccaagcacgaguggaugaccaccgaggacaugcucgccgucuggaaccgcguguggauccaggagaacccguggauggaggacaagacccccguggagagcugggaggagguccccuaccugggcaagcgggaggaccaguggugcgggagccugaucggccucacgucccgcgcgaccugggccaagaacauccagaccgccaucaaccaggugcggagccugaucgggaacgaggaguacaccgacuacaugcccuccaugaagcgcuuccgccgggaggaggaggaggccggcgugcugugguga

SEQ ID NO: 9277 - RNA, 9876 nt, Artificial Sequence
  derived and/or modified CDS sequence (opt1) from DENV-2__FJ906956__SS-prME
accgccggcgucaucgucaugcugauccccaccgccauggcguuccaccucaccacccggaacggggagccgcacaugaucgugggcaagcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccgccgggagaagcgcuccguggcccuggugccccacgucgggaugggccucgagacccggaccgagaccuggaugagcuccgagggggccuggaagcacgugcagcggaucgagaccuggauccugcggcacccgggcuucaccaucauggccgcgauccuggccuacaccaucgggaccacccacuuccagcgggcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccggugcccgacgcagggcgagcccagccugaacgaggagcaggacaagcgguucaucugcaagcacuccaugguggaccgcggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccggcaaggacagccccgugaacaucgaggcggagccgcccuucggggacuccuacaucaucaucggcguggagccggggcagcugaagcucaacugguucaagaagggcagcuccaucggccagauguucgagacgaccaugcgcggggccaagcgcauggccauccugggcgacaccgccugggacuucgggagccugggcggggucuucaccuccaucggcaaggcccuccaccagguguucggcgcgaucuacggggccgccuucagcggcguguccuggacgaugaagauccugaucggggucaucaucaccuggaucggcaugaacagccgguccaccagccuguccgugagccuggugcucgucgggguggugacccuguaccugggcgccaugguccaggcggacuccggcugcguggugagcuggaagaacaaggagcucaagugcggguccggcaucuucaucacggacaacguccacaccuggaccgagcaguacaaguuccagcccgagagccccagcaagcuggccuccgccauccagaaggcccacgaggaggggaucugcggcauccgcagcgugacccggcuggagaaccucauguggaagcagaucacgcccgagcugaaccacauccuguccgagaacgaggugaagcucaccaucaugaccggggacauccgcggcaucaugcaggccggcaagcggagccugcgcccgcagcccaccgagcugaaguacuccuggaagacgugggggaaggcgaagaugcucagcaccgagucccacaaccagaccuuccugaucgacggccccgagaccgccgagugcccgaacacgaaccgggccuggaacagccuggaggucgaggacuacggguucggcguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggggugcuggagagcgagauggucauccccaagaacuucgccggccccgugucccagcacaacuaccgcccgggguaccacacgcagaccgcgggccccuggcaccucgggaagcuggagauggacuucgaccugugcgagggcaccaccguggucgugacggaggacugcggcaaccgggggcccagccuccgcaccaccaccgccagcggcaagcugaucacggaguggugcugccgguccugcacccugcccccgcuccgcuaccgcggggaggacggcugcugguacgggauggagauccgcccccugaaggagaaggaggagaaccuggugaacagccucgucaccgccggccacggccagaucgacaacuucucccugggggugcugggcauggcccucuuccuggaggagaugcugcggacccgcaucgggacgaagcacgcgauccuccugguggccgucagcuucgugacccugaucaccggcaacauguccuuccgggaccucgggcgcgugauggucauggugggcgccaccaugacggacgacaucggcaugggggugaccuaccuggcccugcucgccgcguucaagguccgccccaccuucgccgccggccugcugcuccggaagcugaccagcaaggagcugaugauggccacgaucgggaucgcccuccugucccagagcaccauccccgagaccauccuggagcucaccgacgcgcuggcccugggcaugauggugcucaagaucgugcgcaacauggagaaguaccagcuggccgucacgaucauggccaucuccugcgugccgaacgccgugauccugcagaacgcguggaaggucagcugcaccauccucgccgccguguccgucagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccaucauggccguggggauggugagcauccuggccuccagccugcucaagaacgacauccccaugacgggcccccuggucgccggcgggcugcucaccgugugcuacgugcugaccgggcggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacgcugaccauccucauccggaccgggcugcuggugaucagcggcguguucccggucuccauccccaucaccgcggccgccugguaccucugggaggugaagaagcagcgcgccggggugcugugggacguccccagcccgccgcccguggagaaggccgagcuggaggacggcgcguaccggaucaagcagcgcgggauccucggcuacucccagaucggcgccgggguguacaaggagggcaccuuccacacgauguggcacgucacccgcggggcggugcugaugcaccggggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgcggugcagaccaagcccggcaucuucaagaccaacacggggaccaucggcgccgucagccucgacuucucccccggcaccagcgggucccccaucguggaccggaagggcaagguggucgggcuguacggcaacggcguggugacccgcagcggggccuacgucuccgccaucgcgcagacggagaaguccaucgaggacaaccccgagaucgaggacgacaucuuccggaagaagcgccugaccaucauggaccuccaccccggcgccgggaagaccaagcgguaccugcccgccaucgugcgcgaggccaucaagcggggccugcgcacccugauccucgccccgacgcgcguggucgcggccgagauggaggaggcccugcgggggcugcccauccgcuaccagaccaccgccaucaagaccgagcacacgggccgggagaucguggaccucaugugccacgccaccuucaccaugcgccugcugagccccgugcggguccccaacuacaaccucaucaucauggacgaggcgcacuucaccgacccggccuccaucgccgcccgcggcuacaucagcacgcggguggagaugggggaggccgcgggcaucuucaugaccgccacgccgcccgggucccgcgaccccuucccgcagagcaacgcccccaucauggacgaggagcgggagauccccgagcgcuccuggaacagcggccacgagugggugaccgacuucaaggggaagacggucugguucgugcccuccaucaaggccggcaacgacaucgcggccugccugcggaagaacggcaagcgcgugauccagcugagccggaagaccuucgacuccgaguacgucaagacccgcgccaacgacugggacuucguggugaccacggacaucagcgagaugggggccaacuucaaggccgagcgggucaucgacccgcgccggugcaugaagcccgugauccucaccgacggcgaggagcgcgugauccuggcggggcccaugcccgucacccacuccagcgccgcccagcggcgcggccgcaucgggcggaacccgaagaacgagaacgaccaguacaucuacaugggcgagccccuggagaacgacgaggacugcgcccacuggaaggaggccaagaugcuccuggacaacaucaacacccccgagggcaucauccccuccauguucgagccggagcgcgagaagguggacgcgaucgacggggaguaccggcugcgcggcgaggcccggaagacguucguggaccucaugcgccgcggggaccugcccgucuggcuggccuacaagguggccgccgagggcaucaacuacgcggaccgcaaguggugcuucgacgggaucaagaacaaccagauccucgaggagaacauggagguggagaucuggaccaaggagggcgagcggaagaagcugaagccccgcuggcuggacgcccggaucuacagcgacccgcucgcccugaaggaguucaaggaguucgccgcgggccgcaagucccugacccucaaccugaucaccgagauggggcggcugcccacguucaugacccagaaggcccgcaacgcccucgacaaccuggccguccugcacaccgccgaggcgggcgggcgggccuacaaccacgcccucagcgagcugcccgagacccuggagacgcuccugcugcucacccugcuggccaccgugaccggcggcaucuuccucuuccugauguccgggaagggcaucgggaagaugacccugggcaugugcugcaucaucacggccagcauccuccugugguacgcgcagauccagccccacuggaucgccgccuccaucauccuggaguucuuccucaucguccugcugaucccggagcccgagaagcagcgcacgccccaggacaaccagcucaccuacguggugaucgccauccugaccgucguggccgcgacgauggccaacgagaugggguuccuggagaagaccaagaaggaccucggccugggcagcaucaccacccaggagagcgaguccaacauccuggacaucgaccuccggcccgccagcgccuggacgcuguacgccguggcgaccaccuucgucaccccgaugcugcgccacuccaucgagaacagcuccgugaacgugagccucacggccaucgccaaccaggccaccguccugauggggcugggcaagggguggccccucuccaagauggacaucggcgugccccugcuggcgaucgggugcuacagccaggugaaccccaucacccucaccgccgcccugcugcuccuggucgcccacuacgccaucaucggcccgggccugcaggcgaaggccacgcgggaggcccagaagcgcgccgccgcggggaucaugaagaaccccaccguggacggcaucaccgugaucgaccucgagcccauccccuacgacccgaaguucgagaagcagcuggggcaggucaugcugcucauccugugcgugacccaggugcugaugaugcggacgaccugggcccucugcgaggcccugacccuggccaccggccccaucuccacgcucugggaggggaaccccggccgcuucuggaacaccaccaucgccgucagcauggcgaacaucuuccgcggcuccuaccuggccggggccggccuccucuucagcaucaugaagaacaccacgaacacccggcgcgggaccggcaacaucggcgagacccugggggagaaguggaagucccggcugaacgcccucggcaagagcgaguuccagaucuacaagaaguccgggauccaggagguggaccgcacgcuggcgaaggagggcaucaagcgcggggagaccgaccaccacgccgugagccgcggcuccgccaagcugcggugguucgucgagcgcaacauggugacccccgagggcaagguggucgaccucgggugcggccgcggcggguggagcuacuacugcggcgggcugaagaacgugcgcgaggugaaggggcugaccaagggcggcccggggcacgaggagcccauccccauguccacguacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacgcaguucugcaucaaggugcugaaccccuacaugcccagcgucaucgagaagauggaggcccuccagcgcaaguacgggggcgcgcuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagcccgacguggaccucggcuccgggacccggaacaucggcaucgagagcgagaucccgaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcucaccaagcccugggacgucgugcccauggugacccagauggcgaugacggacaccaccccguucggccagcagcgggucuucaaggagaagguggacacccgcacgcaggagcccaaggagggcaccaagaagcugaugaagaucaccgccgaguggcuguggaaggagcucgggaagaagaagacgccccggaugugcacgcgcgaggaguucacccggaaggugcgcagcaacgccgcccugggcgccaucuucaccgacgagaacaaguggaaguccgcgcgggaggccgucgaggacgggcgcuucugggagcugguggaccgggagcgcaaccuccaccuggagggcaagugcgagaccugcguguacaacaugauggggaagcgggagaagaagcugggcgaguucggcaaggccaaggggagccgcgccaucugguacauguggcucggcgcgcgguuccuggaguucgaggcccugggguuccucaacgaggaccacugguucucccgcggcaacagccugagcggggucgagggcgagggccugcaccggcucggguacauccugcgcgacgugggcaagaaggagggcggcgccauguacgccgacgacacggccgggugggacacccggaucacccuggaggaccucaagaacgaggagauggucaccaaccacaugaagggcgagcacaagaagcuggcggaggccaucuucaagcugacguaccagaacaagguggugcgcguccagcggcccaccccgcgcggcaccgugauggacaucaucucccggcgcgaccagcgcgggagcggccagguggggaccuacggccucaacacguucaccaacauggaggcccagcugauccggcagauggagggcgaggggaucuucaaguccauccagcaccugaccgccaccgaggagaucgccguccagaacuggcucgcgcgcgugggccgggagcgccugagccggauggccaucuccggggacgacugcguggucaagcccaucgacgaccgcuucgccagcgcccugacggcccucaacgacaugggcaaggugcggaaggacauccagcagugggagcccucccgcggguggaacgacuggacccaggugcccuucugcagccaccacuuccacgagcuggucaugaaggacggccgggugcugguggucccgugccgcaaccaggacgagcucaucggccgggcgcgcaucucccagggggccggcuggagccugaaggagaccgccugccuggggaaguccuacgcccagauguggacccucauguacuuccaccggcgcgaccugcggcuggccgcgaacgccaucugcagcgccgugcccucccacugggugcccaccagccgcacgaccugguccauccacgccaaccacgaguggaugaccaccgaggacaugcucgcggucuggaaccggguguggauccaggagaaccccuggauggaggacaagacgccgguggagagcugggaggagguccccuaccugggcaagcgcgaggaccaguggugcgggucccugaucggccucaccagccgggccaccugggccaagaacauccagaccgccaucaaccaggugcgcagccugaucggcaacgaggaguacacggacuacaugcccuccaugaagcgcuuccggcgcgaggaggaggaggccggggugcugugguga

SEQ ID NO: 9278 - RNA, 9876 nt, Artificial Sequence
  derived and/or modified CDS sequence (opt1) from DENV-2__EU482759__SS-prME
accgccggcgugaucgucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcggcacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgcggggccaucaagcgcggccugcgcacccugauccucgccccgacgcgggugguggcggccgagauggaggaggcccugcgcgggcugcccauccgguaccagaccaccgccaucaagaccgagcacacgggccgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggggaggccgcgggcaucuucaugaccgccacgccgcccgggucccgggaccccuucccgcagagcaacgcccccaucauggacgaggagcgcgagauccccgagcgguccuggaacagcggccacgagugggugaccgacuucaaggggaagacggugugguucguccccuccaucaaggccggcaacgacaucgcggccugccugcgcaagaacggcaagaaggugauccagcugagccggaagaccuucgacuccgaguacgugaagacccgcgccaacgacugggacuucgucgugaccacggacaucagcgagaugggggccaacuucaaggccgagcgggugaucgacccgcgccggugcaugaagcccgucauccucaccgacggcgaggagcgcgugauccuggcggggcccaugcccgugacccacuccagcgccgcccagcggcgcggccgcaucgggcggaacccgaagaacgagaacgaccaguacaucuacaugggcgagccccuggagaacgacgaggacugcgcccacuggaaggaggccaagaugcuccuggacaacaucaacacccccgagggcaucauccccuccauguucgagccggagcgcgagaaggucgacgcgaucgacggggaguaccggcugcgcggcgaggcccggaagacguucguggaccucaugcgccgcggggaccugcccguguggcuggccuacaaggucgccgccgagggcaucaacuacgcggaccgcaaguggugcuucgacgggaucaagaacaaccagauccucgaggagaacauggagguggagaucuggaccaaggagggcgagcggaagaagcugaagccccgcuggcuggacgcccggaucuacagcgacccgcucgcccugaaggaguucaaggaguucgccgcgggccgcaagucccugacccucaaccugaucaccgagauggggcggcugcccacguucaugacccagaaggcccgcaacgcccucgacaaccuggccgugcugcacaccgccgaggcgggcgggcgggccuacaaccacgcccucagcgagcugcccgagacccuggagacgcuccugcugcucacccugcuggccaccgucaccggcggcaucuuccucuuccugauguccgggaagggcaucgggaagaugacccugggcaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggguuccuggagaagaccaagaaggaccucggccugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugauggggcugggcaagggguggccccucuccaagauggacaucggcgucccccugcuggcgaucgggugcuacagccaggugaaccccaucacccucaccgccgcccugcugcuccugguggcccacuacgccaucaucggcccgggccugcaggcgaaggccacgcgggaggcccagaagcgcgccgccgcggggaucaugaagaaccccaccgucgacggcaucaccgugaucgaccucgagcccauccccuacgacccgaaguucgagaagcagcuggggcaggucaugcugcucauccugugcgucacccaggugcugaugaugcggacgaccugggcccucugcgaggcccugacccuggccaccggccccaucuccacgcucugggaggggaaccccggccgcuucuggaacaccaccaucgccgugagcauggcgaacaucuuccgcggcuccuaccuggccggggccggccuccuguucagcaucaugaagaacaccacgaacacccggcgcgggaccggcaacaucggcgagacccugggggagaaguggaagucccggcugaacgcccucggcaagagcgaguuccagaucuacaagaaguccgggauccaggaggucgaccgcacgcuggcgaaggagggcaucaagcgcggggagaccgaccaccacgccgugagccgcggcuccgccaagcugcggugguucguggagcgcaacauggucacccccgagggcaaggugguggaccucgggugcggccgcgggggcuggagcuacuacugcgggggccugaagaacguccgcgaggugaagggccugaccaagggcggcccggggcacgaggagcccauccccauguccacguacggcuggaaccucgugcggcugcagagcggggucgacguguucuucacgccgcccgagaagugcgacacccugcucugcgacaucggcgagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacgggggcgcgcugguccggaacccccugucccgcaacagcacccacgagauguacuggguguccaacgccaccgggaacaucgugagcuccgucaacaugaucagccggaugcugaucaaccgcuucaccaugaagcacaagaaggccacguacgagcccgacguggaccucggcuccgggacccggaacaucggcaucgagagcgagaucccgaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggucgugcgccugcucaccaagcccugggacgugguccccauggugacccagauggcgaugacggacaccaccccguucggccagcagcggguguucaaggagaaggucgacacccgcacgcaggagcccaaggagggcaccaagaagcugaugaagaucaccgccgaguggcuguggaaggagcucgggaagaagaagacgccccggaugugcacgcgcgaggaguucacccggaaggugcgcagcaacgccgcccugggcgccaucuucaccgacgagaacaaguggaaguccgcgcgggaggccguggaggacgggcgcuucugggagcuggucgaccgggagcgcaaccuccaccuggagggcaagugcgagaccugcguguacaacaugauggggaagcgggagaagaagcugggcgaguucggcaaggccaaggggagccgcgccaucugguacauguggcucggcgcgcgguuccuggaguucgaggcccugggguuccucaacgaggaccacugguucucccgcggcaacagccugagcgggguggagggcgagggccugcaccggcucggguacauccugcgcgacgucggcaagaaggagggcggcgccauguacgccgacgacacggccgggugggacacccggaucacccuggaggaccucaagaacgaggagauggugaccaaccacaugaagggcgagcacaagaagcuggcggaggccaucuucaagcugacguaccagaacaaggucgugcgcgugcagcggcccaccccgcgcggcaccgucauggacaucaucucccggcgcgaccagcgcgggagcggccagguggggaccuacggccucaacacguucaccaacauggaggcccagcugauccggcagauggagggcgaggggaucuucaaguccauccagcaccugaccgccaccgaggagaucgccgugcagaacuggcucgcgcgcgucggccgggagcgccugagccggauggccaucuccggggacgacugcguggugaagcccaucgacgaccgcuucgccagcgcccugacggcccucaacgacaugggcaagguccggaaggacauccagcagugggagcccucccgcggguggaacgacuggacccaggugcccuucugcagccaccacuuccacgagcuggugaugaaggacggccggguccugguggugccgugccgcaaccaggacgagcucaucggccgggcgcgcaucucccagggggccggcuggagccugaaggagaccgccugccuggggaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccugggcaagcgcgaggaccaguggugcgggucccugaucggccucaccagccgggccaccugggccaagaacauccagaccgccaucaaccagguccgcagccugaucggcaacgaggaguacacggacuacaugcccuccaugaagcgcuuccggcgcgaggaggaggaggccggggugcugugguga

SEQ ID NO: 9279 - RNA, 9876 nt, Artificial Sequence
  derived and/or modified CDS sequence (opt1) from DENV-2__EU482760__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcgccaccaccggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucacgaucauggcggccauccuggccuacaccaucgggaccacccacuuccagcgggcccucaucuucauccugcugacggcgguggcccccagcaugaccaugcgcugcaucggcaucuccaaccgggacuucgucgagggcgugagcgggggcuccuggguggacaucguccucgagcacgggagcugcgugaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcgggcuguucggcaagggcgggaucgucacgugcgccauguucacgugcaagaagaacauggagggcaagguggugcagcccgagaaccuggaguacaccaucgucaucacgccccacagcggggaggagcacgccgugggcaacgacacggggaagcacggcaaggagaucaagaucaccccgcaguccagcaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggcggacacccagggcagcaacuggauccagaaggagacccuggugacguucaagaacccccacgccaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgcggagacccagcacgggaccaucgugauccgcguccaguacgagggcgacggcucccccugcaagauccccuucgagaucacggaccuggagaagcggcacgugcucgggcgccugaucaccgugaacccgaucgucaccgagaaggacagccccgugaacaucgaggccgagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcgcuccaccagguguucggggccaucuacggcgccgccuucagcgggguguccuggaccaugaagauccugaucggcgucaucaucacguggaucgggaugaacagccgcuccaccagccuguccgugagccuggugcucgucggcguggugacccuguaccugggggcgaugguccaggccgacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggugaagcucacgaucaugaccggcgacauccgggggaucaugcaggcgggcaagcgcagccugcggccgcagcccaccgagcugaaguacuccuggaagaccuggggcaaggccaagaugcucagcacggagucccacaaccagaccuuccugaucgacgggcccgagaccgccgagugcccgaacaccaaccgcgccuggaacagccuggaggucgaggacuacggcuucgggguguucacgaccaacaucuggcucaagcugcgggagaagcaggacguguucugcgacuccaagcugaugagcgccgcgaucaaggacaaccgcgccguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgcggggcccgucucccagcacaacuaccggccgggcuaccacacccagacggccgggcccuggcaccucggcaagcuggagauggacuucgaccugugcgaggggaccaccgugguggucaccgaggacugcggcaaccgcggccccagccuccggacgaccaccgccagcgggaagcugaucaccgaguggugcugccgcuccugcacgcugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccuguuccuggaggagaugcugcgcacccggaucggcaccaagcacgccauccuccugguggccgugagcuucgucacgcugaucaccgggaacauguccuuccgcgaccucggccgcgugauggugauggucggggccaccaugaccgacgacaucggcaugggcgugacguaccuggcccugcucgcggccuucaaggugcggcccaccuucgccgccgggcugcugcuccgcaagcugaccagcaaggagcugaugauggccaccaucggcaucgcgcuccugucccagagcacgauccccgagaccauccuggagcucaccgacgcccuggcccuggggaugaugguccucaagaucgugcggaacauggagaaguaccagcuggccgugaccaucauggccaucuccugcgucccgaacgcggugauccugcagaacgccuggaaggugagcugcacgauccucgccgccgucuccgugagcccccugcugcucaccuccagccagcagaaggcggacuggaucccccuggcccugaccaucaagggccucaaccccaccgccaucuuccugacgacccugucccgcaccagcaagaagcgguccuggccgcucaacgaggccaucauggccgucggcauggugagcauccuggcguccagccugcucaagaacgacauccccaugaccgggccccugguggccggcgggcugcucacggucugcuacgugcugaccggccgcagcgccgaccuggagcucgagcgggccgccgacgugaagugggaggaccaggcggagaucuccgggagcucccccauccugagcaucaccaucuccgaggacggcagcauguccaucaagaacgaggaggaggagcagacccugacgauccucauccgcaccggccugcuggucaucagcgggguguucccgguguccauccccaucaccgccgccgccugguaccucugggaggucaagaagcagcgggccggcgugcugugggacgugcccagcccgccgcccgucgagaaggcggagcuggaggacggggccuaccgcaucaagcagcggggcauccucggguacucccagaucggcgccggcguguacaaggaggggaccuuccacaccauguggcacgugacgcgcggcgccguccugaugcaccgggggaagcgcaucgagcccagcugggccgacgugaagaaggaccugaucuccuacggcgggggcuggaagcucgagggcgaguggaaggagggggaggaggugcagguccuggcgcuggagcccggcaagaacccccgggccgugcagaccaagcccgggaucuucaagaccaacaccggcacgaucggggccgugagccucgacuucucccccggcaccagcggcucccccaucgucgaccgcaaggggaagguggugggccuguacgggaacggcgucgugacccggagcggcgccuacguguccgcgaucgcccagaccgagaaguccaucgaggacaaccccgagaucgaggacgacaucuuccgcaagaagcggcugacgaucauggaccuccaccccggggccggcaagaccaagcgcuaccugcccgccaucguccgggaggccaucaagcgcgggcugcgcacccugauccucgcgccgacccgggugguggccgccgagauggaggaggcccugcgcggccugcccauccgguaccagacgaccgccaucaagaccgagcacaccgggcgcgagaucgucgaccucaugugccacgcgacguucaccaugcggcugcugagccccgugcgcgugcccaacuacaaccucaucaucauggacgaggcccacuucaccgacccggccuccaucgccgcccggggcuacaucagcacccgcgucgagaugggcgaggcggccgggaucuucaugacggccacgccgcccggcucccgggaccccuucccgcagagcaacgcccccaucauggacgaggagcgcgagauccccgagcgguccuggaacagcgggcacgagugggugaccgacuucaagggcaagaccgugugguucguccccuccaucaaggcggggaacgacaucgccgccugccugcgcaagaacggcaagaaggugauccagcugagccggaagacguucgacuccgaguacgugaagacccgcgccaacgacugggacuucgucgugaccaccgacaucagcgagaugggcgccaacuucaaggcggagcgggugaucgacccgcgccggugcaugaagcccgucauccucacggacggggaggagcgcgugauccuggccggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggcgaagaugcuccuggacaacaucaacacccccgagggcaucauccccuccauguucgagccggagcgcgagaaggucgacgccaucgacggcgaguaccggcugcgcggggaggcccggaagaccuucguggaccucaugcgccggggcgaccugcccguguggcuggccuacaaggucgccgcggaggggaucaacuacgccgaccgcaaguggugcuucgacggcaucaagaacaaccagauccucgaggagaacauggagguggagaucuggacgaaggagggggagcggaagaagcugaagccccgcuggcuggacgcccggaucuacagcgacccgcucgcccugaaggaguucaaggaguucgcggccggccgcaagucccugacccucaaccugaucaccgagaugggccggcugcccaccuucaugacgcagaaggcccgcaacgcccucgacaaccuggccgugcugcacaccgcggaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgcgagcauccuccugugguacgcccagauccagccccacuggaucgccgccuccaucauccuggaguucuuccucaucgugcugcugaucccggagcccgagaagcagcgcacgccccaggacaaccagcucaccuacgucgugaucgccauccugaccguggucgcggccaccauggccaacgagaugggcuuccuggagaagacgaagaaggaccucgggcugggcagcaucaccacccaggagagcgaguccaacauccuggacaucgaccuccggcccgccagcgccuggacccuguacgcgguggccacgaccuucgugaccccgaugcugcgccacuccaucgagaacagcuccgucaacgugagccucaccgccaucgccaaccaggcgacggugcugaugggccuggggaagggcuggccccucuccaagauggacaucggggucccccugcuggccaucggcugcuacagccaggugaaccccaucacccucaccgccgcccugcugcuccugguggcccacuacgcgaucaucgggccgggccugcaggccaaggccacccgggaggcccagaagcgcgccgcggccggcaucaugaagaaccccacggucgacgggaucaccgugaucgaccucgagcccauccccuacgacccgaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgcggugagcauggccaacaucuuccgcggcuccuaccuggccggcgccgggcuccucuucagcaucaugaagaacaccaccaacacgcggcgcggcaccgggaacaucggcgagacccugggcgagaaguggaagucccggcugaacgcgcucggcaagagcgaguuccagaucuacaagaaguccggcauccaggaggucgaccgcacccuggccaaggaggggaucaagcggggcgagacggaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccaccuacggguggaaccucgugcggcugcagagcggcgucgacguguucuucacgcccccggagaagugcgacacccugcucugcgacaucggggagagcucccccaaccccaccaucgaggccggccgcacccugcgggugcugaaccucgucgagaacuggcugaacaacaacacccaguucugcaucaaggugcugaaccccuacaugccgagcgugaucgagaagauggaggcgcuccagcgcaaguacggcggggcccugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagcccgacguggaccucggguccggcacgcggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagaccaagcagacgggguccgcgagcuccauggugaacggcgucgugcgccugcucaccaagcccugggacgugguccccauggugacccagauggccaugaccgacacgaccccguucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggcgaucuucaccgacgagaacaaguggaaguccgcccgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgcgggcugggacacgcggaucacccuggaggaccucaagaacgaggagauggugaccaaccacaugaagggggagcacaagaagcuggccgaggccaucuucaagcugaccuaccagaacaaggucgugcgcgugcagcggcccacgccgcgcggcaccgucauggacaucaucucccggcgcgaccagcgcggcagcggccaggugggcaccuacgggcucaacaccuucacgaacauggaggcccagcugauccggcagauggagggcgagggcaucuucaaguccauccagcaccugaccgccaccgaggagaucgcggugcagaacuggcucgcccgcgucgggcgggagcgccugagccggauggccaucuccggcgacgacugcguggugaagcccaucgacgaccgcuucgccagcgcccugaccgcgcucaacgacauggggaagauccggaaggacauccagcagugggagcccucccgcggcuggaacgacuggacgcagguccccuucugcagccaccacuuccacgagcuggugaugaaggacgggcgggugcuggucgugccgugccgcaaccaggacgagcucaucggccgggcccgcaucucccagggcgccggguggagccugaaggagaccgccugccugggcaaguccuacgcccagauguggacccucauguacuuccaccggcgcgaccugcggcuggcggccaacgccaucugcagcgccgugcccucccacuggguccccaccagccgcaccacgugguccauccacgcgaagcacgaguggaugaccaccgaggacaugcucgccguguggaaccggguguggauccaggagaaccccuggauggaggacaagaccccggucgagagcugggaggaggugcccuaccuggggaagcgcgaggaccaguggugcggcucccugaucgggcucacgagccgggccaccugggccaagaacauccagaccgccaucaaccaggugcgcagccugaucggcaacgaggaguacaccgacuacaugcccuccaugaagcgcuuccggcgcgaggaggaggaggcgggcguccugugguga

SEQ ID NO: 9280 - RNA, 9876 nt, Artificial Sequence
  derived and/or modified CDS sequence (opt1) from DENV-2__EU482762__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugcuacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcucccugaucgggcucaccagccgggccaccugggccaagaacauccagaccgccaucaaccagguccgcagccugaucggcaacgaggaguacacggacuacaugcccuccaugaagcgcuuccggcgcgaggaggaggaggccggcgugcugugguga

SEQ ID NO: 9281 - RNA, 9876 nt, Artificial Sequence
  derived and/or modified CDS sequence (opt1) from DENV-2__EU482763__SS-prME
accgccggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacaccgaccgcaaguggugcuucgacggcaucaagaacaaccagauccucgaggagaacauggagguggagaucuggaccaaggagggggagcggaagaagcugaagccccgcuggcuggacgcgcggaucuacagcgacccgcucgcccugaaggaguucaaggaguucgccgccggccgcaagucccugacccucaaccugaucacggagaugggccggcugcccaccuucaugacccagaaggcgcgcaacgcccucgacaaccuggccgugcugcacaccgccgaggccgggggccgggcguacaaccacgcccucagcgagcugcccgagacgcuggagacccuccugcugcucacccugcuggccaccgucaccgggggcaucuuccucuuccugauguccggcaaggggaucggcaagaugacgcuggggaugugcugcaucaucaccgccagcauccuccugugguacgcccagauccagccccacuggaucgcggccuccaucauccuggaguucuuccucaucgugcugcugaucccggagcccgagaagcagcgcacgccccaggacaaccagcucaccuacgucgugaucgccauccugacgguggucgccgccaccauggcgaacgagaugggcuuccuggagaagaccaagaaggaccucgggcugggcagcaucaccacgcaggagagcgaguccaacauccuggacaucgaccuccggcccgccagcgccuggacccuguacgccguggccaccaccuucgugacgccgaugcugcgccacuccaucgagaacagcuccgucaacgugagccucaccgcgaucgccaaccaggccaccgugcugaugggccuggggaagggcuggccccucuccaagauggacaucggggucccccugcuggccaucggcugcuacagccaggugaaccccaucacccucacggcggcccugcugcuccugguggcccacuacgccaucaucgggccgggccugcaggccaaggcgacccgggaggcccagaagcgcgccgccgccggcaucaugaagaaccccaccgucgacgggaucaccgugaucgaccucgagcccauccccuacgacccgaaguucgagaagcagcugggccaggugaugcugcucauccugugcgucacccagguccugaugaugcggaccaccugggcgcucugcgaggcccugacccuggccacggggcccaucuccacccucugggagggcaaccccgggcgcuucuggaacaccaccaucgccgugagcauggccaacaucuuccgcggcuccuaccuggcgggcgccgggcuccuguucagcaucaugaagaacacgaccaacacccggcgcggcaccgggaacaucggcgagacgcugggcgagaaguggaagucccggcugaacgcccucggcaagagcgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggccgggccacgaggagcccauccccauguccaccuacggguggaaccucgugcggcugcagagcggcgucgacguguucuucacgccgcccgagaagugcgacacccugcucugcgacaucggggagagcucccccaaccccaccaucgaggccggccgcacgcugcgggugcugaaccucgucgagaacuggcugaacaacaacacccaguucugcaucaaggugcugaaccccuacaugcccagcgugaucgagaagauggaggcccuccagcgcaaguacggcggggcccugguccggaacccccugucccgcaacagcacccacgagauguacuggguguccaacgcgaccggcaacaucgugagcuccgucaacaugaucagccggaugcugaucaaccgcuucacgaugaagcacaagaaggccaccuacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgucgugcgccugcucaccaagcccugggacgugguccccauggugacgcagauggccaugaccgacaccaccccguucgggcagcagcggguguucaaggagaaggucgacacgcgcacccaggagcccaaggagggcaccaagaagcugaugaagaucaccgcggaguggcuguggaaggagcucggcaagaagaagacgccccggaugugcacccgcgaggaguucacccggaaggugcgcagcaacgccgcccugggggccaucuucaccgacgagaacaaguggaaguccgcccgggaggcgguggaggacggccgcuucugggagcuggucgaccgggagcgcaaccuccaccuggaggggaagugcgagacgugcguguacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgggaacagccugagcggcguggagggggagggccugcaccggcucggcuacauccugcgcgacgucgggaagaaggagggcggggccauguacgccgacgacaccgccggcugggacacccggaucacccuggaggaccucaagaacgaggagauggugacgaaccacaugaagggggagcacaagaagcuggccgaggcgaucuucaagcugaccuaccagaacaaggucgugcgcgugcagcggcccaccccgcgcggcaccgucauggacaucaucucccggcgcgaccagcgcggcagcggccaggugggcacguacgggcucaacaccuucaccaacauggaggcccagcugauccggcagauggagggcgagggcaucuucaaguccauccagcaccugaccgccacggaggagaucgccgugcagaacuggcucgcccgcgucgggcgggagcgccugagccggauggcgaucuccggcgacgacugcguggugaagcccaucgacgaccgcuucgccagcgcccugaccgcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcccgcaucucccagggcgcgggguggagccugaaggagaccgccugccugggcaaguccuacgcccagauguggacccucauguacuuccaccggcgcgaccugcggcuggccgccaacgcgaucugcagcgccguccccucccacugggugcccacgagccgcaccaccugguccauccacgccaagcacgaguggaugaccacggaggacaugcucgccguguggaaccgggucuggauccaggagaaccccuggauggaggacaagaccccgguggagagcugggaggaggugcccuaccuggggaagcgcgaggaccaguggugcggcucccugaucgggcucaccagccgggcgaccugggccaagaacauccagacggccaucaaccagguccgcagccugaucggcaacgaggaguacaccgacuacaugcccuccaugaagcgcuuccggcgcgaggaggaggaggccggcgugcugugguga

SEQ ID NO: 9282 - RNA, 9876 nt, Artificial Sequence
  derived and/or modified CDS sequence (opt1) from DENV-2__EU482444__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccauccaggagagcgaguccaacauccuggacaucgaccuccggcccgccagcgccuggacccuguacgccguggcgacgaccuucgugaccccgaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacccgggaggcccagaagcgcgccgccgcgggcaucaugaagaaccccacggucgacgggaucaccgugaucgaccucgagcccauccccuacgacccgaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcugaacgcccucggcaagagcgaguuccagaucuacaagaaguccggcauccaggaggucgaccgcacccuggcgaaggaggggaucaagcggggcgagacggaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccaccuacggguggaaccucgugcggcugcagagcggcgucgacguguucuucacgcccccggagaagugcgacacccugcucugcgacaucggggagagcucccccaaccccaccaucgaggccggccgcacccugcgggugcugaaccucgucgagaacuggcugaacaacaacacccaguucugcaucaaggugcugaaccccuacaugccgagcgugaucgagaagauggaggcccuccagcgcaaguacggcggggcgcugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagcccgacguggaccucggguccggcacgcggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacgugguccccauggugacccagauggcgaugaccgacacgaccccguucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggugauguacgccgacgacaccgccggcugggacacgcggaucacccuggaggaccucaagaacgaggagcuggucaccaaccacaugaagggggagcacaagaagcuggccgaggcgaucuucaagcucaccuaccagaacaagguggugcgcguccagcggcccacgccgcgcggcaccgugauggacaucaucucccggcgcgaccagcgcggcagcgggcaggucggcaccuacgggcugaacaccuucacgaacauggaggcccagcugauccggcagauggagggcgagggcaucuucaaguccauccagcaccucaccgccaccgaggagaucgccguccagaacuggcuggcccgcguggggcgggagcgccugagccggauggcgaucuccggcgacgacugcguggucaagcccaucgacgaccgcuucgccagcgcccucaccgcccugaacgacauggggaaggugcggaaggacauccagcagugggagcccucccgcggcuggaacgacuggacccaggugcccuucugcagccaccacuuccacgagcuggucaugaaggacgggcgggugcucguggucccgugccgcaaccaggacgagcugaucggccgggcccgcaucucccagggcgcgggguggagccugaaggagaccgccugccucggcaaguccuacgcccagauguggacccugauguacuuccaccggcgcgaccugcggcucgccgccaacgcgaucugcagcgccgugcccucccacugggugcccaccagccgcaccacgugguccauccacgccaagcacgaguggaugaccaccgaggacaugcuggccgucuggaaccggguguggauccaggagaaccccuggauggaggacaagaccccgguggagagcugggaggagguccccuaccuggggaagcgcgaggaccaguggugcggcucccucaucgggcugacgagccgggcgaccugggccaagaacauccagaccgccaucaaccaggugcgcagccugaucggcaacgaggaguacaccgacuacaugcccuccaugaagcgcuuccggcgcgaggaggaggaggccggcgugcucugguga

SEQ ID NO: 9283 - RNA, 9876 nt, Artificial Sequence
  derived and/or modified CDS sequence (opt1) from DENV-2__EU482684__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccaccauccuggcguacaccaucgggacgacccacuuccagcgggcccucaucuucauccugcugaccgccguggcccccagcaugaccaugcgcugcaucggcaucagcaaccgggacuucgucgagggcgugagcgggggcagcuggguggacaucguccucgagcacgggagcugcgugacgaccauggcgaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcgggcuguucggcaagggcggcaucgugaccugcgccauguucacgugcaagaagaacauggagggcaagguggugcagcccgagaaccuggaguacacgaucgucaucacgccccacagcggggaggagcacgcggugggcaacgacaccgggaagcacggcaaggagaucaagaucaccccgcaguccagcaucaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgccaagaagcaggacgucgugguccucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacagccccgugaacaucgaggccgagccgcccuucggcgacuccuacaucaucaucgggguggagccgggccagcugaagcucaacugguucaagaaggggagcuccaucggccagauguucgagaccaccaugcgcggcgcgaagcggauggccauccugggggacaccgccugggacuucggcagccucgggggcgucuucacguccaucgggaaggcccuccaccagguguucggcgccaucuacggcgcggccuucagcgggguguccuggaccaugaagauccugaucggcgucaucaucaccuggaucgggaugaacagccgcuccaccagccuguccgugagccuggugcucgucggcguggugacgcuguaccugggggccgucgugcaggccgacuccggcugcguggucagcuggaagaacaaggagcucaagugcggcuccgggaucuucaucaccgacaacgugcacaccuggaccgagcaguacaaguuccagcccgagagccccagcaagcuggcguccgccauccagaaggcccacgaggagggcaucugcgggauccggagcgugacgcgccuggagaaccucauguggaagcagaucacccccgagcugaaccacauccuguccgagaacgaggucaagcucaccaucaugaccggcgacaucaaggggaucaugcaggccggcaagcggagccugcgcccgcagcccacggagcugaaguacuccuggaagaccuggggcaaggccaagaugcucagcaccgagucccacaaccagaccuuccugaucgacgggcccgagacggcggagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggccgugcacgcggacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgccgggcccuggcaccucggcaagcuggagauggacuucgacuucugcgaggggaccacgguggucgugaccgaggacugcggcaaccggggccccagccugcgcaccaccacggcgagcgggaagcucaucaccgaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacgcgcaucggcaccaagcacgccauccugcucguggcggucagcuucgugacccugaucaccgggaacauguccuuccgggaccugggccgcgugauggucauggugggggccacgaugaccgacgacaucggcaugggcgugaccuaccucgcccugcuggccgccuucaagguccgccccaccuucgcggccgggcuccugcugcggaagcucacgagcaaggagcugaugauggccaccaucggcaucgcccugcucucccagagcaccauccccgagaccauccuggagcugacggacgcccucgcgcuggggaugauggugcugaagaucgugcgcaacauggagaaguaccagcucgccgucaccaucauggccaucuccugcgugccgaacgccgugauccugcagaacgccuggaaggucagcugcaccauccuggcggccguguccgucagcccccuccugcugaccuccagccagcagaaggccgacuggaucccccucgcccugacgaucaagggccugaaccccaccgcgaucuuccucaccacccugucccggacgagcaagaagcgcuccuggccgcugaacgaggccaucauggccgugggcauggugagcauccucgccuccagccugcugaagaacgacauccccaugaccgggccccucgucgccggcgggcugcugaccgugugcuacgugcucaccggccggagcgcggaccuggagcuggagcgcgccgccgacgucaagugggaggaccaggccgagaucuccgggagcucccccauccucagcaucacgaucuccgaggacggcagcauguccaucaagaacgaggaggaggagcagacccugaccauccugauccggaccggccuccuggugaucagcgggguguucccggucuccauccccaucaccgccgcggccugguaccugugggaggugaagaagcagcgcgccggcgugcucugggacguccccagcccgccgcccguggagaaggccgagcuggaggacggggccuaccggaucaagcagcgcggcauccugggguacucccagaucggcgcgggcguguacaaggaggggacguuccacaccauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgccgugcagaccaagcccgggaucuucaagacgaacaccggcaccaucggggcggucagccuggacuucucccccggcaccagcggcucccccaucguggaccggaaggggaagguggucggccucuacgggaacggcguggugacgcgcagcggcgccuacgucuccgccaucgcccagaccgagaaguccaucgaggacaaccccgagaucgaggacgacaucuuccggaagaagcgccugaccaucauggaccugcaccccggggcgggcaagaccaagcgguaccuccccgccaucgugcgcgaggccaucaagcgggggcugcgcacgcugauccuggccccgacccgcguggucgccgcggagauggaggaggcccuccggggccugcccauccgcuaccagacccccgccaucaagaccgagcacacggggcgggagaucguggaccugaugugccacgccaccuucaccaugcgccuccugagccccgugcgggucccgaacuacaaccugaucaucauggacgaggcccacuucaccgaccccgcguccaucgccgcccgcggcuacaucagcacgcggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugaccgacuucaagggcaagacggucugguucgugccguccaucaaggccgggaacgacaucgccgcgugccuccggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccccggcgcugcaugaagcccgugauccugaccgacggggaggagcgggugauccucgccggccccaugccggucacccacuccagcgcggcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcgcgcaagacguucguggaccugaugcggcgcggcgaccuccccgucuggcuggccuacaagguggccgccgaggggaucaacuacgccgaccggaaguggugcuucgacggcaucaagaacaaccagauccuggaggagaacauggagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucaccgagaugggccgccugcccacguucaugacccagaaggcgcggaacgcccuggacaaccucgccguccugcacaccgccgaggccgggggccgcgcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcggacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcgcccggccagcgccuggacgcucuacgccguggccaccaccuucgucacccccaugcugcggcacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgcgaggcccagaagcgggccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcgcacgaccugggcgcugugcgaggcccucacccuggccaccgggcccaucuccacgcugugggagggcaaccccgggcgguucuggaacaccaccaucgccgucagcauggccaacaucuuccgcggcuccuaccucgcgggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgccaaggaggggaucaagcgcggcgagaccgaccaccacgcggugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcacguacggguggaaccugguccgccuccagagcggcguggacguguucuucaccccgcccgagaagugcgacacccugcugugcgacaucggggaguccagccccaaccccaccaucgaggccggccggacccuccgcguccugaaccugguggagaacuggcucaacaacaacacgcaguucugcaucaaggugcugaacccguacaugcccuccgucaucgagaagauggaggcccugcagcggcaguacggcggggcccucgugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcugaccaagcccugggacgucgugccgauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagacgccccgcaugugcacccgggaggaguucacgaagaaggugcgcuccaacgccgcccucggggccaucuucaccgacgagaacaaguggaaguccgcccgggaggcggucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcccgguuccucgaguucgaggcgcugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacgcggaucacccuggaggaccugaagaacgaggagauggucaccaaccacaugaagggggagcacaagaagcucgccgaggcgaucuucaagcugaccuaccagaacaagguggugcgcguccagcggccgacgccccgcggcaccgugauggacaucaucagccggcgcgaccagcggggcuccgggcaggucggcaccuacgggcugaacaccuucacgaacauggaggcccagcucauccgccagauggagggcgagggcaucuucaagagcauccagcaccugaccgccaccgaggagaucgccguccagaacuggcuggcccgcguggggcgggagcgccucucccggauggcgaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcccgcaucagccagggcgcgggguggucccucaaggagaccgccugccugggcaagagcuacgcccagauguggacccugauguacuuccaccggcgcgaccuccggcuggccgccaacgcgaucugcuccgccgugcccagccacugggugcccaccucccgcaccacguggagcauccacgccaagcacgaguggaugaccaccgaggacaugcuggccgucuggaaccggguguggauccaggagaacccguggauggaggacaagacccccguggaguccugggaggagguccccuaccucgggaagcgcgaggaccaguggugcggcagccugaucgggcugacgagccgggcgaccugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9284 - RNA, 9876 nt, Artificial Sequence
  derived and/or modified CDS sequence (opt1) from DENV-2__EU482685__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggaacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgucacccccaugcugcggcacuccaucgagaacagcuccgugaacgugagccugaccgccaucgccaaccaggccacgguccucaugggccuggggaagggcuggccccuguccaagauggacaucggggugccccuccuggcgaucggcugcuacagccaggugaacccgaucacccugaccgccgcccuccugcugcucgucgcccacuacgccaucaucgggcccggccugcaggcgaaggccacccgcgaggcccagaagcgggccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcgcaccacgugggcccugugcgaggcccucacccuggccaccgggcccaucuccacccugugggagggcaaccccgggcgguucuggaacacgaccaucgccgucagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggagguggaccggacccucgcgaaggaggggaucaagcgcggcgagacggaccaccacgccgugucccgggggagcgccaagcugcgcugguucgucgagcggaacauggugaccccggagggcaagguggucgaccugggcugcgggcgcggcgggugguccuacuacugcggcgggcucaagaacgugcggcaggucaagggccugaccaagggcgggcccggccacgaggagcccauccccaugagcaccuacggguggaaccugguccgccuccagagcggcguggacguguucuucacgccgcccgagaagugcgacacccugcugugcgacaucggggaguccagccccaaccccaccaucgaggccggccggacccuccgcguccugaaccugguggagaacuggcucaacaacaacacccaguucugcaucaaggugcugaacccguacaugcccuccgucaucgagaagauggaggcccugcagcggcaguacggcggggcgcucgugcgcaacccccugagccggaacuccacgcacgagauguacugggugagcaacgccaccggcaacaucgucuccagcgugaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagaccgggagcgccuccagcauggucaacggcguggugcgccugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucaccaagaaggugcgcuccaacgccgcccucggggccaucuucacggacgagaacaaguggaaguccgcgcgggaggccgucgaggacggccgcuucugggagcugguggaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcgucgagggggagggccugcaccggcugggcuacauccuccgcgacguggggaagaaggagggcggggccauguacgccgacgacaccgccggcugggacacccggaucacgcuggaggaccugaagaacgaggagauggucaccaaccacaugaagggggagcacaagaagcucgcggaggccaucuucaagcugaccuaccagaacaagguggugcgcguccagcggccgacgccccgcggcacggugauggacaucaucagccggcgcgaccagcggggcuccggccaggugggcaccuacgggcugaacaccuucaccaacauggaggcccagcucauccgccagauggagggcgagggcaucuucaagagcauccagcaccugacggccaccgaggagaucgccguccagaacuggcuggcgcgcguggggcgggagcgccucucccggauggccaucagcggcgacgacugcguggucaagcccaucgacgaccgcuucgccuccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacugggugcccaccucccgcaccaccuggagcauccacgccaagcacgaguggaugacgaccgaggacaugcuggcggucuggaaccggguguggauccaggagaacccguggauggaggacaagacccccguggaguccugggaggagguccccuaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccggcgugcugugguga

SEQ ID NO: 9285 - RNA, 9876 nt, Artificial Sequence
  derived and/or modified CDS sequence (opt1) from DENV-2__EU482687__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcggugcuggccuacaccaucgggaccacgcacuuccagcgggcccucaucuucguccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacgucguggugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccgugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgacuucugcgaggggaccaccgugguggucacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcaucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugaugguccugaagaucgugcgcaacauggagaaguaccagcucgccgugacgaucauggccaucuccugcgucccgaacgccgugauccugcagaacgcguggaaggucagcugcaccauccuggccgccguguccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgucggcauggugagcauccucgccuccagccugcugaagaacgacauccccaugacggggccccucguggcgggcgggcugcugaccgucugcuacgugcucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggucaucagcgggguguucccgguguccauccccaucaccgcggccgccugguaccugugggaggucaagaagcagcgcgccggcgugcucugggacgugcccagcccgccgcccgucgagaaggccgagcuggaggacggggcguaccggaucaagcagcgcggcauccugggguacucccagaucggcgccggcguguacaaggaggggaccuuccacacgauguggcacgugacccggggcgccguccucaugcaccgcgggaagcggaucgagcccagcugggccgacgugaagaaggaccugaucuccuacggcgggggcuggaagcuggagggcgaguggaaggagggggaggaggugcagguccucgcccuggagcccggcaagaacccccgcgcggugcagaccaagcccgggaucuucaagaccaacacgggcaccaucggggccgugagccuggacuucucccccggcaccagcggcucccccaucgucgaccggaaggggaagguggugggccucuacgggaacggcgucgugacccgcagcggcgccuacguguccgccaucgcgcagacggagaaguccaucgaggacaaccccgagaucgaggacgacaucuuccggaagaagcgccugaccaucauggaccugcaccccggggccggcaagaccaagcgguaccuccccgccaucguccgcgaggccaucaagcgggggcugcgcacccugauccuggccccgacgcgcgugguggcggccgagauggaggaggcccuccggggccugcccauccgcuaccagacccccgccaucaagaccgagcacaccgggcgggagaucgucgaccugaugugccacgccacguucaccaugcgccuccugagccccgugcgggugccgaacuacaaccugaucaucauggacgaggcgcacuucaccgaccccgccuccaucgccgcccgcggcuacaucagcacccgggucgagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggccgggaacgacaucgcggccugccuccggaagaacggcaagaaggugauccagcugagccgcaagacguucgacuccgaguacgugaagacccgggccaacgacugggacuucgucgugaccaccgacaucagcgagaugggcgccaacuucaaggccgagcgcgugaucgacccccggcgcugcaugaagcccgucauccugacggacggggaggagcgggugauccucgcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaaggucgacgcgaucgacggcgaguaccgccugcgcggggaggcccgcaagaccuucguggaccugaugcggcgcggcgaccuccccguguggcuggccuacaaggucgccgccgaggggaucaacuacgcggaccggaaguggugcuucgacggcaucaagaacaaccagauccuggaggagaacauggagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccguccugcacaccgccgaggccgggggccgcgccuacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcggacgccccaggacaaccagcugaccuacgucgugaucgccauccucaccguggucgccgcgaccauggccaacgagaugggcuuccuggagaagacgaagaaggaccuggggcucggcagcaucaccacccaggagagcgaguccaacauccuggacaucgaccugcgcccggccagcgccuggacccucuacgccguggcgacgaccuucgugacccccaugcugcggcacuccaucgagaacagcuccgucaacgugagccugaccgccaucgccaaccaggccacggugcucaugggccuggggaagggcuggccccuguccaagauggacaucggggucccccuccuggcgaucggcugcuacagccaggugaacccgaucacccugaccgccgcccuccugcugcucguggcccacuacgccaucaucgggcccggccugcaggcgaaggccacccgcgaggcccagaagcgggccgccgcgggcaucaugaagaaccccacggucgacgggaucaccgugaucgaccuggagcccaucccguacgaccccaaguucgagaagcagcucggccaggugaugcugcugauccucugcgucacccaggugcugaugaugcgcaccacgugggcccugugcgaggcccucacccuggccaccgggcccaucuccacccugugggagggcaaccccgggcgguucuggaacacgaccaucgccgugagcauggcgaacaucuuccgcggcuccuaccucgccggcgccgggcugcuguucagcaucaugaagaacaccaccuccacgcgccggggcaccgggaacaucggcgagacccucggcgagaaguggaagucccgccugaacgcccuggggaaguccgaguuccagaucuacaagaaguccggcauccaggaggucgaccggacccucgcgaaggaggggaucaagcgcggcgagacggaccaccacgccgugucccgggggagcgccaagcugcgcugguucguggagcggaacauggucaccccggagggcaaggugguggaccugggcugcgggcgcggcgggugguccuacuacugcggcgggcucaagaacguccgggaggugaagggccugaccaagggcgggcccggccacgaggagcccauccccaugagcaccuacggguggaaccuggugcgccuccagagcggcgucgacguguucuucacgccgcccgagaagugcgacacccugcugugcgacaucggggaguccagccccaaccccaccaucgaggccggccggacccuccgcgugcugaaccuggucgagaacuggcucaacaacaacacccaguucugcaucaaggugcugaacccguacaugcccuccgugaucgagaagauggaggcccugcagcggcaguacggcggggcgcucguccgcaacccccugagccggaacuccacgcacgagauguacugggugagcaacgccaccggcaacaucguguccagcgucaacaugaucucccgcaugcugaucaaccgguucaccaugaagcacaagaaggccaccuacgagccggacguggaccuggggagcggcacgcgcaacaucgggaucgaguccgagauccccaaccucgacaucaucggcaagcggaucgagaagaugaagcaggagcacgagaucagcuggcacuacgaccaggaccaccccuacaagaccugggccuaccacggcuccuacgagaccaagcagaccgggagcgccuccagcauggugaacggcgucgugcgccugcugacgaagcccugggacguggucccgauggugacccagauggcgaugaccgacaccacgcccuucgggcagcagcgcguguucaaggagaaggucgacacccggacccaggagcccaaggagggcaccaagaagcucaugaagaucacggccgaguggcuguggaaggagcugggcaagaagaagacgccccgcaugugcacccgggaggaguucacccgcaaggugcgguccaacgccgcccucggggccaucuucacggacgagaacaaguggaaguccgcgcgcgaggccguggaggacggccgguucugggagcuggucgaccgcgagcggaaccugcaccucgaggggaagugcgagaccugcguguacaacaugaugggcaagcgcgagaagaagcugggggaguucggcaaggccaagggcucccgggccaucugguacauguggcugggggcgcgcuuccucgaguucgaggcccugggcuuccugaacgaggaccacugguucagccgggggaacagccucuccggcgucgagggggagggccugcaccgccugggcuacauccuccgggacguggggaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggucgugcgggugcagcgcccgacgccccggggcacggucauggacaucaucagccgccgggaccagcgcggcuccggccaggugggcaccuacgggcugaacaccuucaccaacauggaggcccagcucauccgccagauggagggcgagggcaucuucaagagcauccagcaccugacggccaccgaggagaucgccgugcagaacuggcuggcgcgggucgggcgcgagcggcucucccgcauggccaucagcggcgacgacugcguggugaagcccaucgacgaccgguucgccuccgcccugaccgcccugaacgacauggggaagguccgcaaggacauccagcagugggagcccagccggggcuggaacgacuggacccaggugccguucugcucccaccacuuccacgagcucgugaugaaggacgggcgcguccugguggugcccugccggaaccaggacgagcugaucggccgcgcgcggaucagccagggcgccggguggucccucaaggagacggccugccugggcaagagcuacgcccagauguggacccugauguacuuccaccgccgggaccuccgccuggccgcgaacgccaucugcuccgccguccccagccacugggugcccaccucccggaccaccuggagcauccacgccaagcacgaguggaugacgaccgaggacaugcuggcgguguggaaccgcgucuggauccaggagaacccguggauggaggacaagacccccguggaguccugggaggaggugcccuaccucgggaagcgggaggaccaguggugcggcagccugaucgggcugaccagccgcgccacgugggccaagaacauccaggccgccaucaaccagguccggucccucaucggcaacgaggaguacaccgacuacaugcccagcaugaagcgcuuccgccgggaggaggaggaggcgggcgugcugugguga

SEQ ID NO: 9286 - RNA, 9876 nt, Artificial Sequence
  derived and/or modified CDS sequence (opt1) from DENV-2__EU482688__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggugaagcucacgaucaugaccggcgacauccgggggaucaugcaggccggcaagcgcagccugcggccgcagcccaccgagcugaaguacuccuggaagaccuggggcaaggcgaagaugcucagcacggagucccacaaccagaccuuccugaucgacgggcccgagaccgccgagugcccgaacaccaaccgcgccuggaacagccuggaggucgaggacuacggcuucgggguguucacgaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacccagacggcggggcccuggcaccucggcaagcuggagauggacuucgaccugugcgaggggaccaccgugguggucaccgaggacugcggcaaccgcggccccagccuccggacgaccaccgccagcgggaagcugaucaccgaguggugcugccgcuccugcacgcugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcaccaagcacgcgauccuccugguggccgugagccuggucacgcucaucaccgggaacauguccuuccgcgaccugggccgcgugauggugauggucggggccaccaugaccgacgacaucggcaugggcgugacguaccuggcccuccuggccgcguucaaggugcggcccaccuucgccgccgggcugcuccugcgcaagcugaccagcaaggagcucaugauggccaccaucggcaucgcccugcugucccagagcacgauccccgagaccauccucgagcugaccgacgcgcuggcccucgggaugaugguccugaagaucgugcggaacauggagaaguaccagcuggccgugaccaucauggccaucuccugcgucccgaacgccgugauccuccagaacgcguggaaggugagcugcacgauccuggccgccgucuccgugagcccccugcuccugaccuccagccagcagaaggccgacuggaucccccuggcgcucaccaucaagggccugaaccccaccgccaucuuccugacgacccucucccgcaccagcaagaagcgguccuggccgcugaacgaggccaucauggccgucggcauggugagcauccuggccuccagccuccugaagaacgacauccccaugaccgggccccugguggcgggcgggcuccugacggucugcuacgugcugaccggccgcagcgccgaccucgagcuggagcgggccgccgacgugaagugggaggaccaggccgagaucuccgggagcucccccauccugagcaucaccaucuccgaggacggcagcauguccaucaagaacgaggaggaggagcagacccucacgauccugauccgcaccggccugcucgucaucagcgggguguucccgguguccauccccaucaccgcggccgccugguaccugugggaggucaagaagcagcgggccggcgugcugugggacgugcccagcccgccgcccgucgagaaggccgagcucgaggacggggcguaccgcaucaagcagcggggcauccugggguacucccagaucggcgccggcguguacaaggaggggaccuuccacaccauguggcacgugacgcgcggcgccguccugaugcaccgggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggcggugcagaccaagcccgggaucuucaagaccaacaccggcacgaucggggccgugagccuggacuucucccccggcaccagcggcucccccaucgucgaccgcaaggggaagguggugggccuguacgggaacggcgucgugacccggagcggcgccuacguguccgccaucgcgcagaccgagaaguccaucgaggacaaccccgagaucgaggacgacaucuuccgcaagaagcggcucacgaucauggaccugcaccccggggccggcaagaccaagcgcuaccugcccgccaucguccgggaggccaucaagcgcgggcugcgcacccucauccuggccccgacccgggugguggcggccgagauggaggaggcccugcgcggccuccccauccgguaccagacgaccgccaucaagaccgagcacaccgggcgcgagaucgucgaccugaugugccacgccacguucaccaugcggcugcucagccccgugcgcgugcccaacuacaaccugaucaucauggacgaggcgcacuucaccgacccggccuccaucgccgcccggggcuacaucagcacccgcgucgagaugggcgaggccgcggggaucuucaugacggccacgccgcccggcucccgggaccccuucccgcagagcaacgcccccaucauggacgaggagcgcgagauccccgagcgguccuggaacagcgggcacgagugggugaccgacuucaagggcaagaccgugugguucguccccuccaucaaggccgggaacgacaucgcggccugccugcgcaagaacggcaagaaggugauccagcucagccggaagacguucgacuccgaguacgugaagacccgcgccaacgacugggacuucgucgugaccaccgacaucagcgagaugggcgccaacuucaaggccgagcgggugaucgacccgcgccggugcaugaagcccgucauccugacggacggggaggagcgcgugauccuggcgggccccaugcccgugacccacuccagcgccgcccagcggcgcgggcgcaucggccggaacccgaagaacgagaacgaccaguacaucuacaugggggagccccucgagaacgacgaggacugcgcccacuggaaggaggccaagaugcugcuggacaacaucaacacccccgagggcaucauccccuccauguucgagccggagcgcgagaaggucgacgcgaucgacggcgaguaccggcuccgcggggaggcccggaagaccuucguggaccugaugcgccggggcgaccugcccguguggcucgccuacaaggucgccgccgaggggaucaacuacgcggaccgcaaguggugcuucgacggcaucaagaacaaccagauccuggaggagaacauggagguggagaucuggacgaaggagggggagcggaagaagcugaagccccgcuggcucgacgcccggaucuacagcgacccgcuggcccugaaggaguucaaggaguucgccgcgggccgcaagucccucacccugaaccugaucaccgagaugggccggcuccccaccuucaugacgcagaaggcccgcaacgcccuggacaaccuggccgugcuccacaccgccgaggccgggggccgggccuacaaccacgcccugagcgagcugcccgagacccucgagacccugcugcuccugacgcugcucgccaccgucaccgggggcaucuuccuguuccugauguccggcaaggggaucggcaagaugacccucgggaugugcugcaucaucaccgccagcauccugcugugguacgcgcagauccagccccacuggaucgccgccuccaucauccucgaguucuuccugaucgugcugcucaucccggagcccgagaagcagcgcacgccccaggacaaccagcugaccuacgucgugaucgccauccugaccguggucgccgcgaccauggccaacgagaugggcuuccucgagaagacgaagaaggaccuggggcugggcagcaucaccacccaggagagcgaguccaacauccucgacaucgaccugcggcccgccagcgccuggacccuguacgccguggcgacgaccuucgugaccccgaugcuccgccacuccaucgagaacagcuccgucaacgugagccugaccgccaucgccaaccaggccacggugcugaugggccucgggaagggcuggccccuguccaagauggacaucggggucccccugcucgcgaucggcugcuacagccaggugaaccccaucacccugaccgccgcccugcuccugcugguggcccacuacgccaucaucgggccgggccuccaggcgaaggccacccgggaggcccagaagcgcgccgccgcgggcaucaugaagaaccccacggucgacgggaucaccgugaucgaccuggagcccauccccuacgacccgaaguucgagaagcagcugggccaggugaugcuccugauccugugcgucacccaggugcucaugaugcggaccacgugggcccugugcgaggcccugacccucgccaccgggcccaucuccacccugugggagggcaaccccgggcgcuucuggaacacgaccaucgccgugagcauggcgaacaucuuccgcggcuccuaccuggccggcgccgggcuccuguucagcaucaugaagaacaccaccaacacgcggcgcggcaccgggaacaucggcgagacccugggcgagaaguggaagucccggcucaacgcccugggcaagagcgaguuccagaucuacaagaaguccggcauccaggaggucgaccgcacccuggcgaaggaggggaucaagcggggcgagacggaccaccacgccgugagccgcggguccgccaagcuccggugguucguggagcgcaacauggucacccccgagggcaaggugguggaccugggcugcgggcggggcggguggagcuacuacugcggcgggcugaagaacguccgcgaggugaagggccucaccaagggcgggccgggccacgaggagcccauccccauguccaccuacggguggaaccuggugcggcugcagagcggcaucgacgucuucuucacgcccccggagaagugcgacacccuccugugcgacaucggggagagcucccccaaccccaccaucgaggccggccgcacccugcgggugcucaaccugguggagaacuggcugaacaacaacacccaguucugcaucaagguccucaaccccuacaugccgagcgugaucgagaagauggaggcccugcagcgcaaguacggcggggcgcuggugcggaacccccugucccgcaacagcacgcacgagauguacugggucuccaacgccaccggcaacaucgugagcuccgugaacaugaucagccggaugcucaucaaccgcuucaccaugaagcacaagaaggccaccuacgagcccgacgucgaccugggguccggcacgcggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccuccugaccaagcccugggacguggugcccauggucacccagauggcgaugaccgacacgaccccguucgggcagcagcggguguucaaggagaagguggacacccgcacccaggagcccaaggagggcacgaagaagcugaugaagaucaccgccgaguggcucuggaaggagcugggcaagaagaagacgccccggaugugcacccgcgaggaguucacgcggaagguccgcagcaacgccgcccugggggccaucuucaccgacgagaacaaguggaaguccgcgcgggaggccguggaggacggccgcuucugggagcucguggaccgggagcgcaaccugcaccuggaggggaagugcgagaccugcgucuacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcguggagggggagggccuccaccggcugggcuacauccugcgcgacguggggaagaaggagggcggggccauguacgccgacgacaccgccggcugggacacgcggaucacccucgaggaccugaagaacgaggagauggucaccaaccacaugaagggggagcacaagaagcuggcggaggccaucuucaagcucaccuaccagaacaaggugguccgcgugcagcggcccacgccgcgcggcaccgugauggacaucaucucccggcgcgaccagcgcggcagcgggcaggucggcaccuacgggcugaacaccuucacgaacauggaggcccagcugauccggcagauggagggcgagggcaucuucaaguccauccagcaccucaccgccaccgaggagaucgccgugcagaacuggcuggcgcgcguggggcgggagcgccugagccggauggccaucuccggcgacgacugcgucgugaagcccaucgacgaccgcuucgccagcgcccucaccgcccugaacgacauggggaaggugcggaaggacauccagcagugggagcccucccgcggcuggaacgacuggacgcagguccccuucugcagccaccacuuccacgagcuggugaugaaggacgggcgggugcucgucgugccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccgugcccucccacuggguccccaccagccgcaccacgugguccauccacgccaagcacgaguggaugaccaccgaggacaugcuggcgguguggaaccggguguggauccaggagaaccccuggauggaggacaagaccccggucgagagcugggaggaggugcccuaccuggggaagcgcgaggaccaguggugcggcuccaugaucgggcucacgagccgggccaccugggccaagaacauccagaccgccaucaaccaggugcgcagccugaucggcaacgaggaguacaccgacuacaugcccuccaugaagcgcuuccggcgcgaggaggaggaggccggcguccugugguga

SEQ ID NO: 9287 - RNA, 9876 nt, Artificial Sequence
  derived and/or modified CDS sequence (opt1) from DENV-2__EU482691__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacaucaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacguccggugggaggaccaggccgagaucuccgggagcucccccauccucagcaucaccaucuccgaggacggcagcauguccaucaagaacgaggaggaggagcagacccugacgauccugauccgcaccggccuccuggugaucagcgggguguucccggucuccauccccaucaccgcggccgccugguaccugugggaggugaagaagcagcgggccggcgugcucugggacguccccagcccgccgcccguggagaaggccgagcuggaggacggggcguaccgcaucaagcagcggggcauccugggguacucccagaucggcgccggcguguacaaggaggggaccuuccacaccauguggcacgucacgcgcggcgccgugcucaugcaccgggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggaucuucaagaccaacaccggcacgaucggggccgucagccuggacuucucccccggcaccagcggcucccccaucguggaccgcaaggggaagguggucggccucuacgggaacggcguggugacccggagcggcgccuacgucuccgccaucgcgcagaccgagaaguccaucgaggacaaccccgagaucgaggacgacaucuuccgcaagaagcggcugacgaucauggaccugcaccccggggccggcaagaccaagcgcuaccuccccgccaucgugcgggaggccaucaagcgcgggcugcgcacccugauccuggccccgacccggguggucgcggccgagauggaggaggcccuccgcggccugcccauccgguaccagacgcccgccaucaagaccgagcacaccgggcgcgagaucguggaccugaugugccacgccaccuucacgaugcggcuccugagccccgugcgcgucccgaacuacaaccugaucaucauggacgaggcgcacuucaccgaccccgccuccaucgccgcccggggcuacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgcggccugccuccgcaagaacggcaagaaggugauccagcugagccggaagaccuucgacuccgaguacgucaagacgcgcgccaacgacugggacuucguggugaccaccgacaucagcgagaugggcgccaacuucaaggccgagcgggucaucgacccccgccggugcaugaagcccgugauccugaccgacggggaggagcgcgugauccucgcgggccccaugccggucacgcacuccagcgccgcccagcggcgcgggcgcaucggccggaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgcgagaagguggacgcgaucgacggcgaguaccggcugcgcggggaggcccggaagaccuucguggaccugaugcgccggggcgaccuccccgucuggcuggccuacaagguggccgccgaggggaucaacuacaccgaccgcaaguggugcuucgacggcaucaagaacaaccagauccuggaggagaacauggagguggagaucuggacgaaggagggggagcggaagaagcucaagccgcgcuggcuggacgcgcggaucuacagcgacccccuggcccucaaggaguucaaggaguucgccgccggccgcaagucccugacccugaaccucaucaccgagaugggccggcugcccaccuucaugacgcagaaggcgcgcaacgcccuggacaaccucgccguccugcacaccgccgaggccgggggccgggcguacaaccacgcccugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcccagauccagccgcacuggaucgcggccuccaucauccuggaguucuuccugaucguccuccugauccccgagcccgagaagcagcgcacgccccaggacaaccagcugaccuacguggugaucgccauccucaccgucguggccgccaccauggcgaacgagaugggcuuccuggagaagacgaagaaggaccuggggcucggcagcaucaccacccaggagagcgaguccaacauccuggacaucgaccugcggccggccagcgccuggacccucuacgccguggccacgaccuucgucacccccaugcugcgccacuccaucgagaacagcuccgugaacgugagccugaccgcgaucgccaaccaggccacgguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacccgggaggcccagaagcgcgccgccgccggcaucaugaagaaccccacgguggacgggaucaccgugaucgaccuggagcccaucccguacgaccccaaguucgagaagcagcucggccaggucaugcugcugauccucugcgugacccaggugcugaugaugcggaccacgugggcgcugugcgaggcccucacccuggccaccgggcccaucuccacccugugggagggcaaccccgggcgcuucuggaacacgaccaucgccgucagcauggccaacaucuuccgcggcuccuaccucgcgggcgccgggcugcuguucagcaucaugaagaacaccaccuccacgcggcgcggcaccgggaacaucggcgagacccucggcgagaaguggaagucccggcugaacgcccuggggaaguccgaguuccagaucuacaagaaguccggcauccaggagguggaccgcacccucgccaaggaggggaucaagcggggcgagacggaccaccacgcggugucccgcgggagcgccaagcugcggugguucgucgagcgcaacauggugaccccggagggcaagguggucgaccugggcugcgggcggggcgggugguccuacuacugcggcgggcucaagaacgugcgcgaggugaagggccugaccaagggcgggcccggccacgaggagcccauccccaugagcaccuacggguggaaccugguccggcuccagagcggcguggacguguucuucacgccgcccgagaagugcgacacccugcugugcgacaucggggaguccagccccaaccccaccaucgaggccggccgcacccuccggguccugaaccugguggagaacuggcucaacaacaacacccaguucugcgugaagguccugaacccguacaugcccuccgugaucgagaagauggaggcccugcagcgccaguacggcggggcccucgugcggaacccccugagccgcaacuccacgcacgagauguacugggucagcaacgcgaccggcaacaucguguccagcgugaacaugaucucccggaugcugaucaaccgcuucaccaugaagcacaagaaggccaccuacgagccggacgucgaccuggggagcggcacgcggaacaucgggaucgaguccgagauccccaaccucgacaucaucggcaagcgcaucgagaagaucaagcaggagcacgagaucagcuggcacuacgaccaggaccaccccuacaagaccugggccuaccacggcuccuacgagaccaagcagaccgggagcgccuccagcauggugaacggcgugguccgccugcugacgaagcccugggacguggugccgauggucacccagauggccaugaccgacaccacgcccuucgggcagcagcggguguucaaggagaagguggacacccgcacccaggagcccaaggagggcaccaagaagcucaugaagaucacggcggaguggcuguggaaggagcugggcaagaagaagacgccccggaugugcacccgcgaggaguucacccggaagguccgcuccaacgccgcccucggggccaucuucacggacgagaacaaguggaaguccgcccgggaggcgguggaggacggccgcuucugggagcugguggaccgggagcgcaaccugcaccucgaggggaagugcgagaccugcgucuacaacaugaugggcaagcgggagaagaagcugggggaguucggcaaggccaagggcucccgcgccaucugguacauguggcugggggcccgguuccucgaguucgaggcgcugggcuuccugaacgaggaccacugguucagccgcgggaacagccucuccggcguggagggggagggccugcaccggcugggcuacauccuccgcgacgucgggaagaaggagggcggggccauguacgccgacgacaccgccggcugggacacccggaucacgcuggaggaccugaagaacgaggagauggugaccaaccacaugaagggggagcacaagaagcucgccgaggcgaucuucaagcugaccuaccagaacaaggugguccgcgugcagcggccgacgccccgcggcacggugauggacaucaucagccggcgcgaccagcgcggcuccgggcaggucggcaccuacgggcugaacaccuucaccaacauggaggcccagcucauccggcagauggagggcgagggcaucuucaagagcauccagcaccugacggccaccgaggagaucgccgugcagaacuggcuggcccgcguggggcgggagcgccucucccggauggcgaucagcggcgacgacugcgucgugaagcccaucgacgaccgcuucgccuccgcccugaccgcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcccgcaucagccagggcgcgggguggucccucaaggagacggccugccugggcaagagcuacgcccagauguggacccugauguacuuccaccggcgcgaccuccggcuggccgccaacgcgaucugcuccgccgugcccagccacuggguccccaccucccgcaccaccuggagcauccacgccaagcacgaguggaugacgaccgaggacaugcuggccguguggaaccggguguggauccaggagaacccguggauggaggacaagacccccgucgaguccugggaggaggugcccuaccucgggaagcgcgaggaccaguggugcggcagccugaucgggcugaccagccgggcgacgugggccaagaacauccagaccgccaucaaccaggugcgcucccucaucggcaacgaggaguacaccgacuacaugcccagcaugaagcgcuuccggcgcgaggaggaggaggccggcguccugugguga

SEQ ID NO: 9288 - RNA, 9876 nt, Artificial Sequence
  derived and/or modified CDS sequence (opt1) from DENV-2__EU482693__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgaccugugcgaggggaccaccguggucgugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcaucggcacgaagcacgcgacccuccugguggccgucagcuucgugacccugaucaccgggaacauguccuuccgggaccucggccgcgugauggucauggugggggccacgaugaccgacgacaucggcaugggcgugaccuaccuggcccugcucgccgcguucaagguccgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugauggugcucaagaucgugcgcaacauggagaaguaccagcuggccgucaccaucauggccaucuccugcgugccgaacgccgugauccugcagaacgcguggaaggucagcugcaccauccucgccgccguguccgucagcccccugcugcucaccuccagccagcagaaggccgacuggaucccccuggcgcugacgaucaagggccucaaccccaccgccaucuuccugaccacccugucccggacgagcaagaagcgcuccuggccgcucaacgaggccaucauggccgugggcauggugagcauccuggccuccagccugcucaagaacgacauccccaugaccgggccccuggucgcgggcgggcugcucaccgugugcuacgugcugaccggccggagcgccgaccuggagcucgagcgcgccgccgacgucaagugggaggaccaggccgagaucuccgggagcucccccauccugagcaucacgaucuccgaggacggcagcauguccaucaagaacgaggaggaggagcagacccugaccauccucauccggaccggccugcuggugaucagcgggguguucccggucuccauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacucccagaucggcgccggcguguacaaggaggggacguuccacaccauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagaccaagcccgggaucuucaagacgaacaccggcaccaucggggccgucagccucgacuucucccccggcaccagcggcucccccaucguggaccggaaggggaagguggucggccuguacgggaacggcguggugacgcgcagcggcgccuacgucuccgccaucgcgcagaccgagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacgcugauccucgccccgacccgcguggucgcggccgagauggaggaggcccugcggggccugcccauccgcuaccagacccccgccaucaagaccgagcacacggggcgggagaucguggaccucaugugccacgccaccuucaccaugcgccugcugagccccgugcgggucccgaacuacaaccucaucaucauggacgaggcgcacuucaccgaccccgccuccaucgccgcccgcggcuacaucagcacgcggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagacggucugguucgugccguccaucaaggccgggaacgacaucgcggccugccugcggaagaacggcaagaaggugauccagcugagccgcaagaccuucgacuccgaguacgucaagacccgggccaacgacugggacuucguggugaccacggacaucagcgagaugggcgccaacuucaaggccgagcgcgucaucgacccccggcgcugcaugaagcccgugauccucaccgacggggaggagcgggugauccuggcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgcgaucgacggcgaguaccgccugcgcggggaggcccgcaagacguucguggaccucaugcggcgcggcgaccugcccgucuggcuggccuacaagguggccgccgaggggaucaacuacgcggaccggaaguggugcuucgacggcaucaagaacaaccagauccucgaggagaacauggagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccguccugcacaccgccgaggccgggggccgcgccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgacgauggccaacgagaugggcuuccuggagaagaccaagaaggaccucgggcugggcagcaucaccacccaggagagcgaguccaacauccuggacaucgaccuccgcccggccagcgccuggacgcuguacgccguggcgaccaccuucgucacccccaugcugcggcacuccaucgagaacagcuccgugaacgugagccucacggccaucgccaaccaggccaccguccugaugggccuggggaagggcuggccccucuccaagauggacaucggggugccccugcuggcgaucggcugcuacagccaggugaacccgaucacccucaccgccgcccugcugcuccuggucgcccacuacgccaucaucgggcccggccugcaggcgaaggccacgcgcgaggcccagaagcgggccgccgcgggcaucaugaagaaccccaccguggacgggaucaccgugaucgaccucgagcccaucccguacgaccccaaguucgagaagcagcugggccaggucaugcugcucauccugugcgugacccaggugcugaugaugcgcacgaccugggcccucugcgaggcccugacccuggccaccgggcccaucuccacgcucugggagggcaaccccgggcgguucuggaacaccaccaucgccgucagcauggcgaacaucuuccgcggcuccuaccuggccggcgccgggcuccuguucagcaucaugaagaacaccacguccacccgccggggcaccgggaacaucggcgagacccugggcgagaaguggaagucccgccugaacgcccucgggaaguccgaguuccagaucuacaagaaguccggcauccaggagguggaccggacgcuggcgaaggaggggaucaagcgcggcgagaccgaccaccacgccgugucccgggggagcgccaagcugcgcugguucgucgagcggaacauggugaccccggagggcaagguggucgaccucggcugcgggcgcggcgggugguccuacuacugcggcgggcugaagaacgugcgggaggugaagggccugaccaagggcgggcccggccacgaggagcccauccccaugagcacguacggguggaaccucguccgccugcagagcggcguggacguguucuucaccccgcccgagaagugcgacacccugcucugcgacaucggggaguccagccccaaccccaccaucgaggccggccggacccugcgcguccugaaccucguggagaacuggcugaacaacaacacgcaguucugcaucaaggugcugaacccguacaugcccuccgucaucgagaagauggaggcccuccagcggaaguacggcggggcgcuggugcgcaacccccugagccggaacuccacccacgagauguacugggugagcaacgccaccggcaacaucgucuccagcgugaacaugaucucccgcaugcugaucaaccgguucaccaugaagcacaagaaggccacguacgagccggacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagcccugggacgucgugccgauggugacccagauggcgaugacggacaccacccccuucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaaggugcgguccaacgccgcccugggggccaucuucaccgacgagaacaaguggaaguccgcgcgcgaggccgucgaggacggccgguucugggagcugguggaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcgucgagggggagggccugcaccgccucggcuacauccugcgggacgugagcaagaaggagggcggcgccauguacgccgacgacacggccgggugggacacccgcaucacccuggaggaccucaagaacgaggagauggucaccaaccacaugaagggcgagcacaagaagcuggcggaggccaucuucaagcugacguaccagaacaagguggugcggguccagcgcccgacgccccgggggaccgugauggacaucaucucccgccgggaccagcgcggcagcggccagguggggaccuacggccucaacacguucaccaacauggaggcccagcugauccgccagauggagggggagggcaucuucaaguccauccagcaccugaccgccgccgaggagaacgucgugcagaacuggcucgcgcgggugggccgcgagcggcugagccgcauggccaucuccggggacgacugcgucgugaagcccaucgacgaccgguucgccagcgcccugaccgcccucaacgacaugggcaaggugcgcaaggacauccagcagugggagcccucccggggguggaacgacuggacgcaggucccguucugcagccaccacuuccacgagcuggugaugaaggacggccgcgugcuggucgugcccugccggaaccaggacgagcucaucgggcgcgcgcggaucucccagggcgccggcuggagccugaaggagaccgccugccuggggaaguccuacgcccagauguggacccucauguacuuccaccgccgggaccugcgccuggccgcgaacgccaucugcagcgccgugcccucccacuggguccccaccagccggaccacgugguccauccacgccaagcacgaguggaugaccaccgaggacaugcucgcgguguggaaccgcguguggauccaggagaacccguggauggaggacaagacccccgucgagagcugggaggaggugcccuaccugggcaagcgggaggaccaguggugcgggagccugaucggccucacgucccgcgccaccugggccaagaacauccagaccgccaucaaccaggugcggagccugaucgggaacgaggaguacaccgacuacaugcccuccaugaagcgcuuccgccgggaggaggaggaggccggcguccugugguga

SEQ ID NO: 9289 - RNA, 9876 nt, Artificial Sequence
  derived and/or modified CDS sequence (opt1) from DENV-2__EU596483__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccgucgugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggauggaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacucccagaucggcgccggcguguacaaggaggggaccuuccacacgauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucagccuggacuucucccccggcaccagcggcucccccaucguggaccggaaggggaagguggucggccucuacgggaacggcguggugacccgcagcggcgccuacgucuccgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccuggccccgacgcgcguggucgcggccgagauggaggaggcccuccggggccugcccauccgcuaccagacccccgccaucaagaccgagcacaccgggcgggagaucguggaccugaugugccacgccacguucaccaugcgccuccugagccccgugcgggucccgaacuacaaccugaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccuccggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccugacggacggggaggagcgggugauccucgcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacacggaccggaaguggugcuucgacggcaucaagaacaaccagauccuggaggagaacauggagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucaccgagaugggccgccugcccacguucaugacccagaaggcgcggaacgcccuggacaaccucgccguccugcacaccgccgaggccgggggccgcgcguacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggccagcauccugcucugguacgcccagauccagccgcacuggaucgcggccuccaucauccuggaguucuuccugaucguccuccugauccccgagcccgagaagcagcggacgccccaggacaaccagcugaccuacguggugaucgccauccucaccgucguggccgccacgauggcgaacgagaugggcuuccuggagaagaccaagaaggaccuggggcucggcagcaucaccacccaggagagcgaguccaacauccuggacaucgaccugcgcccggccagcgccuggacgcucuacgccguggccaccaccuucgucacccccaugcugcggcacuccaucgagaacagcuccgugaacgugagccugacggcgaucgccaaccaggccaccguccucaugggccuggggaagggcuggccccuguccaagauggacaucggggugccccuccuggccaucggcugcuacagccaggugaacccgaucacccugaccgcggcccuccugcugcucgucgcccacuacgccaucaucgggcccggccugcaggccaaggcgacgcgcgaggcccagaagcgggccgccgccggcaucaugaagaaccccaccguggacgggaucaccgugaucgaccuggagcccaucccguacgaccccaaguucgagaagcagcucggccaggucaugcugcugauccucugcgugacccaggugcugaugaugcgcacgaccugggcgcugugcgaggcccucacccuggccaccgggcccaucuccacgcugugggagggcaaccccgggcgguucuggaacaccaccaucgccgucagcauggccaacaucuuccgcggcuccuaccucgcgggcgccgggcugcuguucagcaucaugaagaacaccacguccacccgccggggcaccgggaacaucggcgagacccucggcgagaaguggaagucccgccugaacgcccuggggaaguccgaguuccagaucuacaagaaguccggcauccaggagguggaccggacgcucgccaaggaggggaucaagcgcggcgagaccgaccaccacgcggugucccgggggagcgccaagcugcgcugguucgucgagcggaacauggugaccccggagggcaagguggucgaccugggcugcgggcgcggcgggugguccuacuacugcggcgggcucaagaacgugcgggaggugaagggccugaccaagggcgggcccggccacgaggagcccauccccaugagcacguacggguggaaccugguccgccuccagagcggcguggacguguucuucaccccgcccgagaagugcgacacccugcugugcgacaucggggaguccagccccaaccccaccaucgaggccggccggacccuccgcguccugaaccugguggagaacuggcucaacaacaacacgcaguucugcaucaaggugcugaacccguacaugcccuccgucaucgagaagauggaggcccugcagcggcaguacggcggggcccucgugcgcaacccccugagccggaacuccacccacgagauguacugggugagcaacgcgaccggcaacaucgucuccagcgugaacaugaucucccgcaugcugaucaaccgguucaccaugaagcacaagaaggccacguacgagccggacguggaccuggggagcggcacccgcaacaucgggaucgaguccgagauccccaaccucgacaucaucggcaagcggaucgagaagaucaagcaggagcacgagaucagcuggcacuacgaccaggaccaccccuacaagaccugggccuaccacggcuccuacgagaccaagcagacggggagcgccuccagcauggucaacggcguggugcgccugcugaccaagcccugggacgucgugccgauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagacgccccgcaugugcacccgggaggaguucacgcgcaaggugcgguccaacgccgcccucggggccaucuucaccgacgagaacaaguggaaguccgcccgcgaggcggucgaggacggccgguucugggagcugguggaccgcgagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggggaacagccucuccggcgucgagggggagggccugcaccgccugggcuacauccuccgggacguggggaagaaggagggcggggccauguacgccgacgacaccgccggcugggacacgcgcaucacccuggaggaccugaagaacgaggagauggucaccaaccacaugaagggggagcacaagaagcucgccgaggcgaucuucaagcugaccuaccagaacaagguggugcggguccagcgcccgacgccccggggcaccgugauggacaucaucagccgccgggaccagcgcggcuccgggcaggucggcaccuacgggcugaacaccuucacgaacauggaggcccagcucauccgccagauggagggcgagggcaucuucaagagcauccagcaccugaccgccaccgaggagaucgccguccagaacuggcuggcccggguggggcgcgagcggcucucccgcauggcgaucagcggcgacgacugcguggucaagcccaucgacgaccgguucgccuccgcccugaccgcccugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcccggaucagccagggcgcgggguggucccucaaggagaccgccugccugggcaagagcuacgcccagauguggacccugauguacuuccaccgccgggaccuccgccuggccgccaacgcgaucugcuccgccgugcccagccacugggugcccaccucccggaccacguggagcauccacgccaagcacgaguggaugaccaccgaggacaugcuggccgucuggaaccgcguguggauccaggagaacccguggauggaggacaagacccccguggaguccugggaggagguccccuaccucgggaagcgggaggaccaguggugcggcagccugaucgggcugacgagccgcgcgaccugggccaagaacauccagaccgccaucaaccaggugcggucccucaucggcaacgaggaguacaccgacuacaugcccagcaugaagcgcuuccgccgggaggaggaggagacgggcgugcugugguga

SEQ ID NO: 9290 - RNA, 9876 nt, Artificial Sequence
  derived and/or modified CDS sequence (opt1) from DENV-2__EU482597__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccuguccgaggagcaggacaagcgcuucaucugcaagcacagcaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacuccggggaggagcacgccgugggcaacgacaccgggaagcacggcaaggagaucaagaucaccccgcagagcuccaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacgcuggugaccuucaagaacccccacgcgaagaagcaggacgucgugguccucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgugaaggagaucgccgagacccagcacgggacgaucgugauccgcguccaguacgagggcgacggcagccccugcaagauccccuucgagaucaccgaccuggagaagcggcacgugcucgggcgccugaucaccgugaacccgaucgucaccgagaaggacucccccgugaacaucgaggcggagccgcccuucggcgacagcuacaucaucaucgggguggagccgggccagcugaagcucaacugguucaagaagggguccagcaucggccagauguucgagacgaccaugcgcggcgccaagcggauggccauccugggggacaccgccugggacuucggcucccucgggggcgucuucaccagcaucgggaaggcccuccaccagguguucggcgcgaucuacggcgccgccuucuccggggugagcuggacgaugaagauccugaucggcgucaucaucaccuggaucgggaugaacucccgcagcaccucccugagcgugucccuggugcucgucggcguggugacccuguaccugggggccaugguccaggcggacagcggcugcgugguguccuggaagaacaaggagcucaagugcggcagcgggaucuucaucacggacaacguccacaccuggaccgagcaguacaaguuccagcccgagagccccuccaagcuggccagcgccauccagaaggcccacgaggagggcaucugcgggauccgguccgugacccgccuggagaaccucauguggaagcagaucacgcccgagcugaaccacauccugagcgagaacgaggugaagcucaccaucaugaccggcgacauccgggggaucaugcaggccggcaagcgcucccugcggccgcagcccaccgagcugaaguacagcuggaagacguggggcaaggcgaagaugcucuccaccgagagccacaaccagaccuuccugaucgacgggcccgagaccgccgagugcccgaacacgaaccgcgccuggaacucccuggaggucgaggacuacggcuucgggguguucaccaccaacaucuggcucaagcugcgggagaagcaggacguguucugcgacagcaagcugauguccgccgccaucaaggacaaccgcgcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccuccgggaagcugaucacggaguggugcugccgcagcugcacccugcccccgcuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccggaucggcacgaagcacgcgauccuccugguggccguguccuucgucacccugaucaccgggaacaugagcuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccuccaaggagcugaugauggccacgaucggcaucgcccuccugagccaguccaccauccccgagaccauccuggagcucaccgacgcgcuggcccuggggaugaugguccucaagaucgugcggaacauggagaaguaccagcuggccgugacgaucauggccaucagcugcgucccgaacgccgugauccugcagaacgcguggaagguguccugcaccauccucgccgccgucagcgugagcccccugcugcucaccagcucccagcagaaggccgacuggaucccccuggcgcugaccaucaagggccucaaccccacggccaucuuccugaccacccugagccgcaccuccaagaagcggagcuggccgcucaacgaggccaucauggccgucggcaugguguccauccuggccagcagccugcucaagaacgacauccccaugacggggccccugguggcgggcgggcugcucaccgucugcuacgugcugaccggccgcuccgccgaccuggagcucgagcgggccgccgacgugaagugggaggaccaggccgagaucagcggguccagccccauccuguccaucaccaucagcgaggacggcuccaugagcaucaagaacgaggaggaggagcagacgcugaccauccucauccgcaccggccugcuggucaucuccgggguguucccggugagcauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacagccagaucggcgccggcguguacaaggaggggaccuuccacacgauguggcacgugacccgcggcgccguccugaugcaccgggggaagcgcaucgagcccuccugggccgacgugaagaaggaccugaucagcuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugucccucgacuucagccccggcaccuccggcagccccaucgucgaccgcaaggggaagguggugggccuguacgggaacggcgucgugacccgguccggcgccuacgugagcgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugucccccgugcgcgugcccaacuacaaccucaucaucauggacgaggcgcacuucaccgacccggccagcaucgccgcccggggcuacaucuccacgcgcgucgagaugggcgaggccgcggggaucuucaugaccgccacgccgcccggcagccgggaccccuucccgcaguccaacgcccccaucauggacgaggagcgcgagauccccgagcggagcuggaacuccgggcacgagugggugaccgacuucaagggcaagacggugugguucguccccagcaucaaggccgggaacgacaucgcggccugccugcgcaagaacggcaagaaggugauccagcugucccggaagaccuucgacagcgaguacgugaagacccgcgccaacgacugggacuucgucgugaccacggacaucuccgagaugggcgccaacuucaaggccgagcgggugaucgacccgcgccggugcaugaagcccgucauccucaccgacggggaggagcgcgugauccuggcgggccccaugcccgugacccacagcuccgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccagcauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacuccgacccgcucgcccugaaggaguucaaggaguucgccgcgggccgcaagagccugacccucaaccugaucaccgagaugggccggcugcccacguucaugacccagaaggcccgcaacgcccucgacaaccuggccgugcugcacaccgccgaggccgggggccgggccuacaaccacgcccucuccgagcugcccgagacccuggagacgcuccugcugcucacccugcuggccaccgucaccgggggcaucuuccucuuccugaugagcggcaaggggaucggcaagaugacccuggggaugugcugcaucaucacggccuccauccuccugugguacgcgcagauccagccccacuggaucgccgccagcaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggaguccgagagcaacauccuggacaucgaccuccggcccgccuccgccuggacgcuguacgccguggcgaccaccuucgugaccccgaugcugcgccacagcaucgagaacuccagcgucaacgugucccucacggccaucgccaaccaggccaccgugcugaugggccuggggaagggcuggccccucagcaagauggacaucggggucccccugcuggcgaucggcugcuacucccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucagcacgcucugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaucggcgagacccugggcgagaaguggaagucccggcugaacgcccucgggaaguccgaguuccagaucuacaagaaguccggcauccaggaggucgaccgcacgcuggcgaaggaggggaucaagcggggcgagaccgaccaccacgccgugucccgcgggagcgccaagcugcggugguucguggagcgcaacauggucacccccgagggcaaggugguggaccucggcugcgggcggggcgggugguccuacuacugcggcgggcugaagaacguccgcgaggugaagggccugaccaagggcgggccgggccacgaggagcccauccccaugagcacguacggguggaaccucgugcggcugcagagcggcgucgacguguucuucacgccgcccgagaagugcgacacccugcucugcgacaucggggaguccagccccaaccccaccaucgaggccggccgcacccugcgggugcugaaccucgucgagaacuggcugaacaacaacacgcaguucugcaucaaggugcugaaccccuacaugcccuccgugaucgagaagauggaggcccuccagcgcaaguacggcggggcgcugguccggaacccccugagccgcaacuccacccacgagauguacugggugagcaacgccaccggcaacaucguguccagcgucaacaugaucucccggaugcugaucaaccgcuucaccaugaagcacaagaaggccacguacgagcccgacguggaccucgggagcggcacccggaacaucgggaucgaguccgagaucccgaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcuccaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcucccgcgccaucugguacauguggcucggggcgcgguuccuggaguucgaggcccugggcuuccucaacgaggaccacugguucagccgcgggaacagccuguccggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucagccggcgcgaccagcgcggcuccgggcaggucggcaccuacgggcucaacacguucaccaacauggaggcccagcugauccggcagauggagggcgagggcaucuucaagagcauccagcaccugaccgccaccgaggagaucgccgugcagaacuggcucgcgcgcgucgggcgggagcgccugucccggauggccaucagcggcgacgacugcguggugaagcccaucgacgaccgcuucgccuccgcccugacggcccucaacgacauggggaagauccggaaggacauccagcagugggagcccagccgcggcuggaacgacuggacccagguccccuucugcucccaccacuuccacgagcuggugaugaaggacgggcgggugcuggucgugccgugccgcaaccaggacgagcucaucggccgggcgcgcaucagccagggcgccggguggucccugaaggagaccgccugccugggcaagagcuacgcccagauguggacccucauguacuuccaccggcgcgaccugcggcuggccgcgaacgccaucugcuccgccgugcccagccacuggguccccaccucccgcacgaccuggagcauccacgccaagcacgaguggaugaccaccgaggacaugcucgcgguguggaaccggguguggauccaggagaaccccuggauggaggacaagacgccggucgaguccugggaggaggugcccuaccuggggaagcgcgaggaccaguggugcggcagccugaucgggcucaccagccgggccaccugggccaagaacauccagaccgccaucaaccaggugcgcucccugaucggcaacgaggaguacacggacuacaugcccagcaugaagcgcuuccggcgcgaggaggaggaggccggcguccugugguga

SEQ ID NO: 9291 - RNA, 9876 nt, Artificial Sequence
  derived and/or modified CDS sequence (opt1) from DENV-2__EU482598__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccgucguggugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccggaucggcacgaagcacgcgauccuccuggucgccgugagcuucgugacccugaucaccgggaacauguccuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugauggugcucaagaucguccggaacauggagaaguaccagcuggccgugacgaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgugggcauggucagcauccuggccuccagccugcucaagaacgacauccccaugacggggccccugguggcgggcgggcugcucaccgugugcuacguccugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggugaucagcggggucuucccgguguccauccccaucaccgcggccgccugguaccucugggaggugaagaagcagcgggccggcguccugugggacgugcccagcccgccgcccguggagaaggccgagcuggaggacggggcguaccgcaucaagcagcggggcauccucggguacucccagaucggcgccggcgucuacaaggaggggaccuuccacacgauguggcacgugacccgcggcgccgugcugaugcaccgggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggcgguccagaccaagcccgggaucuucaagaccaacacgggcaccaucggggccgugagccucgacuucucccccggcaccagcggcucccccaucguggaccgcaaggggaaggucgugggccuguacgggaacggcguggucacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcgcacccugauccucgccccgacgcgggucguggcggccgagauggaggaggcccugcgcggccugcccauccgguaccagaccaccgccaucaagaccgagcacacggggcgcgagaucguggaccucaugugccacgccaccuucaccaugcggcugcugagccccguccgcgugcccaacuacaaccucaucaucauggacgaggcgcacuucaccgacccggccuccaucgccgcccggggcuacaucagcacgcgcguggagaugggcgaggccgcggggaucuucaugaccgccacgccgcccggcucccgggaccccuucccgcagagcaacgcccccaucauggacgaggagcgcgagauccccgagcgguccuggaacagcgggcacgagugggucaccgacuucaagggcaagacggugugguucgugcccuccaucaaggccgggaacgacaucgcggccugccugcgcaagaacggcaagaaggucauccagcugagccggaagaccuucgacuccgaguacgugaagacccgcgccaacgacugggacuucguggucaccacggacaucagcgagaugggcgccaacuucaaggccgagcgggugaucgacccgcgccggugcaugaagcccgugauccucaccgacggggaggagcgcgucauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaagguggacgcgaucgacggcgaguaccggcugcgcggggaggcccggaagacguucgucgaccucaugcgccggggcgaccugcccguguggcuggccuacaagguggccgccgaggggaucaacuacgcggaccgcaaguggugcuucgacggcaucaagaacaaccagauccucgaggagaacauggaggucgagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucguccugcugaucccggagcccgagaagcagcgcacgccccaggacaaccagcucaccuacguggucaucgccauccugaccgugguggccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccgucgcgaccaccuucgugaccccgaugcugcgccacuccaucgagaacagcuccgugaacgucagccucacggccaucgccaaccaggccaccgugcugaugggccuggggaagggcuggccccucuccaagauggacaucggggugccccugcuggcgaucggcugcuacagccaggucaaccccaucacccucaccgccgcccugcugcuccugguggcccacuacgccaucaucgggccgggccugcaggcgaaggccacgcgggaggcccagaagcgcgccgccgcgggcaucaugaagaaccccaccguggacgggaucaccgucaucgaccucgagcccauccccuacgacccgaaguucgagaagcagcugggccaggugaugcugcucauccugugcgugacccagguccugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggagguggaccgcacgcuggcgaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggccgggccacgaggagcccauccccauguccacguacggguggaaccucgugcggcugcagagcggcguggacgucuucuucacgccgcccgagaagugcgacacccugcucugcgacaucggggagagcucccccaaccccaccaucgaggccggccgcacccugcgggugcugaaccucguggagaacuggcugaacaacaacacgcaguucugcaucaagguccugaaccccuacaugcccagcgugaucgagaagauggaggcccuccagcgcaaguacggcggggcgcuggugcggaacccccugucccgcaacagcacccacgagauguacugggucuccaacgccaccggcaacaucgugagcuccgugaacaugaucagccggaugcugaucaaccgcuucaccaugaagcacaagaaggccacguacgagcccgacgucgaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccgccugcucaccaagcccugggacguggugcccauggucacccagauggcgaugacggacaccaccccguucgggcagcagcggguguucaaggagaagguggacacccgcacgcaggagcccaaggagggcaccaagaagcugaugaagaucaccgccgaguggcuguggaaggagcucggcaagaagaagacgccccggaugugcacgcgcgaggaguucacccggaagguccgcagcaacgccgcccugggggccaucuucaccgacgagaacaaguggaaguccgcgcgggaggccguggaggacggccgcuucugggagcugguggaccgggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacguggggaagaaggagggcggggccauguacgccgacgacacggccggcugggacacccggaucacccuggaggaccucaagaacgaggagauggucaccaaccacaugaagggggagcacaagaagcuggcggaggccaucuucaagcugacguaccagaacaaggugguccgcgugcagcggcccaccccgcgcggcaccgugauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcguggggcgggagcgccugagccggauggccaucuccggcgacgacugcgucgugaagcccaucgacgaccgcuucgccagcgcccugacggcccucaacgacauggggaaggugcggaaggacauccagcagugggagcccucccgcggcuggaacgacuggacccagguccccuucugcagccaccacuuccacgagcuggugaugaaggacgggcgggugcuggucgugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugcccucccacuggguccccaccagccgcacgaccugguccauccacgccaagcacgaguggaugaccaccgaggacaugcucgcgguguggaaccggguguggauccaggagaaccccuggauggaggacaagacgccggucgagagcugggaggaggugcccuaccuggggaagcgcgaggaccaguggugcggcucccugaucgggcucaccagccgggccaccugggccaagaacauccagaccgccaucaaccaggugcgcagccugaucggcaacgaggaguacacggacuacaugcccuccaugaagcgcuuccggcgcgaggaggaggaggccggcguccugugguga

SEQ ID NO: 9292 - RNA, 9876 nt, Artificial Sequence
  derived and/or modified CDS sequence (opt1) from DENV-2__EU482603__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgccgagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgcgaucaaggacaaccgggccguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgcggggcccgucucccagcacaacuaccgcccgggcuaccacacgcagaccgccgggcccuggcaccucggcaagcuggagauggacuucgaccugugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccuguuccuggaggagaugcugcggacccgcaucggcacgaagcacgccauccuccugguggccgugagcuucgucacccugaucaccgggaacauguccuuccgggaccucggccgcgugauggugauggucggggccaccaugacggacgacaucggcaugggcgugaccuaccuggcccugcucgcggccuucaaggugcgccccaccuucgccgccgggcugcugcuccggaagcugaccagcaaggagcugaugauggccacgaucggcaucgcgcuccugucccagagcaccauccccgagaccauccuggagcucaccgacgcccuggcccuggggaugaugguccucaagaucgugcgcgacauggagaaguaccagcuggccgugacgaucauggccaucuccugcgucccgaacgcggugauccugcagaacgccuggaaggugagcugcaccauccucgccgccgucuccgugagcccccugcugcucaccuccagccagcagaaggcggacuggaucccccuggcccugaccaucaagggccucaaccccacggccaucuuccugaccacccugucccggaccagcaagaagcgcuccuggccgcucaacgaggccaucauggccgucggcauggugagcauccuggcguccagccugcucaagaacgacauccccaugacggggccccugguggccggcgggcugcucaccgucugcuacgugcugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgccgccgccugguaccucugggaggucaagaagcagcgcgccggcgugcugugggacgugcccagcccgccgcccgucgagaaggcggagcuggaggacggggccuaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgcgaucgcccagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgcgccgacgcgcgugguggccgccgagauggaggaggcccugcggggccugcccauccgcuaccagacccccgccaucaagaccgagcacaccgggcgggagaucgucgaccucaugugccacgcgacguucaccaugcgccugcugagccccgugcgggugccgaacuacaaccucaucaucauggacgaggcccacuucaccgaccccgccuccaucgccgcccgcggcuacaucagcacccgggucgagaugggcgaggcggccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagacguucgacuccgaguacgugaagacccgggccaacgacugggacuucgucgugaccaccgacaucagcgagaugggcgccaacuucaaggcggagcgcgugaucgacccccggcgcugcaugaagcccgucauccucacggacggggaggagcgggugauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccaccuucaugacgcagaaggcccggaacgcccucgacaaccuggccgugcugcacaccgcggaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacgucgugaucgccauccugaccguggucgcggccaccauggccaacgagaugggcuuccuggagaagacgaagaaggaccucgggcugggcagcaucaccacccaggagagcgaguccaacauccuggacaucgaccuccgcccggccagcgccuggacccuguacgcgguggccacgaccuucgugacccccaugcugcggcacuccaucgagaacagcuccgucaacgugagccucaccgccaucgccaaccaggcgacggugcugaugggccuggggaagggcuggccccucuccaagauggacaucggggucccccugcuggccaucggcugcuacagccaggugaacccgaucacccucaccgccgcccugcugcuccugguggcccacuacgcgaucaucgggcccggccugcaggccaaggccacccgcgaggcccagaagcgggccgcggccggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgcggugagcauggccaacaucuuccgcggcuccuaccuggccggcgccgggcuccucuucagcaucaugaagaacaccaccuccacgcgccggggcaccgggaacaucggcgagacccugggcgagaaguggaagucccgccugaacgcgcucgggaaguccgaguuccagaucuacaagaaguccggcauccaggaggucgaccggacccuggccaaggaggggaucaagcgcggcgagacggaccaccacgccgugucccgggggagcgccaagcugcgcugguucguggagcggaacauggucaccccggagggcaaggugguggaccucggcugcgggcgcggcgggugguccuacuacugcggcgggcugaagaacguccgggaggugaagggccugaccaagggcgggcccggccacgaggagcccauccccaugagcaccuacggguggaaccucgugcgccugcagagcggcgucgacguguucuucacgccgcccgagaagugcgacacccugcucugcgacaucggggaguccagccccaaccccaccaucgaggccggccggacccugcgcgugcugaaccucgucgagaacuggcugaacaacaacacccaguucugcaucaaggugcugaacccguacaugcccuccgugaucgagaagauggaggcgcuccagcggaaguacggcggggcccugguccgcaacccccugagccggaacuccacgcacgagauguacugggugagcaacgccaccggcaacaucguguccagcgucaacaugaucucccgcaugcugaucaaccgguucaccaugaagcacaagaagaccacguacgagccggacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacguggucccgauggugacccagauggcgaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcgguccaacgccgcccugggggccaucuucaccgacgagaacaaguggaaguccgcgcgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcaccgccucggcuacauccugcgggacgucagcaagaaggagggcggcgccauguacgccgacgacacggccgggugggacacccgcaucacccuggaggaccucaagaacgaggagauggugaccaaccacaugaagggcgagcacaagaagcuggcggaggccaucuucaagcugacguaccagaacaaggucgugcgggugcagcgcccgacgccccgggggaccgucauggacaucaucucccgccgggaccagcgcggcagcggccagguggggaccuacggccucaacacguucaccaacauggaggcccagcugauccgccagauggagggggagggcaucuucaaguccauccagcaccugaccgccaccgaggagaucgugguccagaacuggcucgcccgggugggccgcgagcggcugagccgcauggcgaucuccggggacgacugcguggucaagcccaucgacgaccgguucgccagcgcccugacggcccucaacgacaugggcaaggugcgcaaggacauccagcagugggagcccucccggggguggaacgacuggacccaggugccguucugcagccaccacuuccacgagcuggucaugaaggacggccgcgugcuggugguccccugccggaaccaggacgagcucaucgggcgcgcccggaucucccagggcgcgggcuggagccugaaggagaccgccugccuggggaaguccuacgcccagauguggacccucauguacuuccaccgccgggaccugcgccuggccgccaacgcgaucugcagcgccgugcccucccacugggugcccaccagccggacgaccugguccauccacgccaagcacgaguggaugaccaccgaggacaugcucgccgucuggaaccgcguguggauccaggagaacccguggauggaggacaagacgcccguggagagcugggaggagguccccuaccugggcaagcgggaggaccaguggugcgggagccugaucggccucaccucccgcgcgaccugggccaagaacauccagaccgccaucaaccaggugcggagccugaucgggaacgaggaguacacggacuacaugcccuccaugaagcgcuuccgccgggaggaggaggaggccggcgugcugugguga

SEQ ID NO: 9293 - RNA, 9876 nt, Artificial Sequence
  derived and/or modified CDS sequence (opt1) from DENV-2__EU482599__SS-prME
accgccggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggucaucuccugcgugccgaacgccgugauccugcagaacgccuggaaggucagcugcaccauccucgcggccguguccgucagcccccugcugcucaccuccagccagcagaaggccgacuggaucccccuggcccugaccaucaagggccucaaccccacggcgaucuuccugaccacccugucccgcaccagcaagaagcgguccuggccgcucaacgaggccaucauggccgugggcauggugagcauccuggccuccagccugcucaagaacgacauccccaugacggggccccuggucgccggcgggcugcucaccgugugcuacgugcugaccggccgcagcgcggaccuggagcucgagcgggccgccgacgucaagugggaggaccaggccgagaucuccgggagcucccccauccugagcaucaccaucuccgaggacggcagcauguccaucaagaacgaggaggaggagcagacgcugaccauccucauccgcaccggccugcuggugaucagcgggguguucccggucuccauccccaucaccgccgcggccugguaccucugggaggugaagaagcagcgggccggcgugcugugggacguccccagcccgccgcccguggagaaggccgagcuggaggacggggccuaccgcaucaagcagcggggcauccucggguacucccagaucggcgcgggcguguacaaggaggggaccuuccacacgauguggcacgucacccgcggcgccgugcugaugcaccgggggaagcgcaucgagcccagcugggccgacgugaagaaggaccugaucuccuacggcgggggcuggaagcucgagggcgaguggaaggagggggaggagguccaggugcuggcccuggagcccggcaagaacccccgggccgugcagaccaagcccgggaucuucaagaccaacacgggcaccaucggggcggucagccucgacuucucccccggcaccagcggcucccccaucguggaccgcaaggggaagguggucggccuguacgggaacggcguggugacccggagcggcgccuacgucuccgccaucgcccagacggagaaguccaucgaggacaaccccgagaucgaggacgacaucuuccgcaagaagcggcugaccaucauggaccuccaccccggggcgggcaagaccaagcgcuaccugcccgccaucgugcgggaggccaucaagcgcgggcugcgcacccugauccucgccccgacgcggguggucgccgcggagauggaggaggcccugcgcggccugcccauccgguaccagaccaccgccaucaagaccgagcacacggggcgcgagaucguggaccucaugugccacgccaccuucaccaugcggcugcugagccccgugcgcguccccaacuacaaccucaucaucauggacgaggcccacuucaccgacccggcguccaucgccgcccggggcuacaucagcacgcgcguggagaugggcgaggccgccgggaucuucaugaccgcgacgccgcccggcucccgggaccccuucccgcagagcaacgcccccaucauggacgaggagcgcgagauccccgagcgguccuggaacagcgggcacgagugggugaccgacuucaagggcaagacggucugguucgugcccuccaucaaggccgggaacgacaucgccgcgugccugcgcaagaacggcaagaaggugauccagcugagccggaagaccuucgacuccgaguacgucaagacccgcgccaacgacugggacuucguggugaccacggacaucagcgagaugggcgccaacuucaaggccgagcgggucaucgacccgcgccggugcaugaagcccgugauccucaccgacggggaggagcgcgugauccuggccggccccaugcccgucacccacuccagcgcggcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaagguggacgccaucgacggcgaguaccggcugcgcggggaggcgcggaagacguucguggaccucaugcgccggggcgaccugcccgucuggcuggccuacaagguggccgccgaggggaucaacuacgccgaccgcaaguggugcuucgacggcaucaagaacaaccagauccucgaggagaacauggagguggagaucuggaccaaggagggggagcggaagaagcugaagccccgcuggcuggacgcgcggaucuacagcgacccgcucgcccugaaggaguucaaggaguucgccgccggccgcaagucccugacccucaaccugaucaccgagaugggccggcugcccacguucaugacccagaaggcgcgcaacgcccucgacaaccuggccguccugcacaccgccgaggccgggggccgggcguacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcccagauccagccccacuggaucgcggccuccaucauccuggaguucuuccucaucguccugcugaucccggagcccgagaagcagcgcacgccccaggacaaccagcucaccuacguggugaucgccauccugaccgucguggccgccacgauggcgaacgagaugggcuuccuggagaagaccaagaaggaccucgggcugggcagcaucaccacccaggagagcgaguccaacauccuggacaucgaccuccggcccgccagcgccuggacgcuguacgccguggccaccaccuucgucaccccgaugcugcgccacuccaucgagaacagcuccgugaacgugagccucacggcgaucgccaaccaggccaccguccugaugggccuggggaagggcuggccccucuccaagauggacaucggggugccccugcuggccaucggcugcuacagccaggugaaccccaucacccucaccgcggcccugcugcuccuggucgcccacuacgccaucaucgggccgggccugcaggccaaggcgacgcgggaggcccagaagcgcgccgccgccggcaucaugaagaaccccaccguggacgggaucaccgugaucgaccucgagcccauccccuacgacccgaaguucgagaagcagcugggccaggucaugcugcucauccugugcgugacccaggugcugaugaugcggacgaccugggcgcucugcgaggcccugacccuggccaccgggcccaucuccacgcucugggagggcaaccccgggcgcuucuggaacaccaccaucgccgucagcauggccaacaucuuccgcggcuccuaccuggcgggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggagguggaccgcacgcuggccaaggaggggaucaagcggggcgagaccgaccaccacgcggugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugaccaagggcgggccgggccacgaggagcccauccccauguccacguacggguggaaccucguccggcugcagagcggcguggacguguucuucacgccgcccgagaagugcgacacccugcucugcgacaucggggagagcucccccaaccccaccaucgaggccggccgcacccugcggguccugaaccucguggagaacuggcugaacaacaacacgcaguucugcaucaaggugcugaaccccuacaugcccagcgucaucgagaagauggaggcccuccagcgcaaguacggcggggcccuggugcggaacccccugucccgcaacagcacccacgagauguacuggguguccaacgcgaccggcaacaucgucagcuccgugaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcgccugcucaccaagcccugggacgucgugcccauggugacccagauggccaugacggacaccaccccguucgggcagcagcgggucuucaaggagaagguggacacccgcacgcaggagcccaaggagggcaccaagaagcugaugaagaucaccgcggaguggcuguggaaggagcucggcaagaagaagacgccccggaugugcacgcgcgaggaguucacccggaaggugcgcagcaacgccgcccugggggccaucuucaccgacgagaacaaguggaaguccgcccgggaggcggucgaggacggccgcuucugggagcugguggaccgggagcgcaaccuccaccuggaggggaagugcgagaccugcguguacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgggaacagccugagcggcgucgagggggagggccugcaccggcucggcuacauccugcgcgacguggggaagaaggagggcggggccauguacgccgacgacacggccggcugggacacccggaucacccuggaggaccucaagaacgaggagauggucaccaaccacaugaagggggagcacaagaagcuggccgaggcgaucuucaagcugacguaccagaacaagguggugcgcguccagcggcccaccccgcgcggcaccgugauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccguccagaacuggcucgcccgcguggggcgggagcgccugagccggauggcgaucuccggcgacgacugcguggucaagcccaucgacgaccgcuucgccagcgcccugacggcccucaacgacauggggaaggugcggaaggacauccagcagugggagcccucccgcggcuggaacgacuggacccaggugcccuucugcagccaccacuuccacgagcuggucaugaaggacgggcgggugcugguggucccgugccgcaaccaggacgagcucaucggccgggcccgcaucucccagggcgcgggguggagccugaaggagaccgccugccugggcaaguccuacgcccagauguggacccucauguacuuccaccggcgcgaccugcggcuggccgccaacgcgaucugcagcgccgugcccucccacugggugcccaccagccgcacgaccugguccauccacgccaagcacgaguggaugaccaccgaggacaugcucgccgucuggaaccggguguggauccaggagaaccccuggauggaggacaagacgccgguggagagcugggaggagguccccuaccuggggaagcgcgaggaccaguggugcggcucccugaucgggcucaccagccgggcgaccugggccaagaacauccagaccgccaucaaccaggugcgcagccugaucggcaacgaggaguacacggacuacaugcccuccaugaagcgcuuccggcgcgaggaggaggaggccggcgugcugugguga

SEQ ID NO: 9294 - RNA, 9876 nt, Artificial Sequence
  derived and/or modified CDS sequence (opt1) from DENV-2__FJ898436__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgccuggcuguggaaggagcucggcaagaagaagacgccccggaugugcacgcgcgaggaguucacccggaaggugcgcagcaacgccgcccugggggcgaucuucaccgacgagaacaaguggaaguccgcccgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggcgggcugggacacccggaucacccuggaggaccucaagaacgaggagauggugaccaaccacaugaagggggagcacaagaagcuggccgaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgcggugcagaacuggcucgcccgcgucgggcgggagcgccugagccggauggccaucuccggcgacgacugcguggugaagcccaucgacgaccgcuucgccagcgcccugacggcgcucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcccgcaucucccagggcgccggguggagccugaaggagaccgccugccugggcaaguccuacgcccagauguggacccucauguacuuccaccggcgcgaccugcggcuggcggccaacgccaucugcagcgccguccccucccacugggugcccaccagccgcacgaccugguccauccacgcgaagcacgaguggaugaccaccgaggacaugcucgccguguggaaccgggucuggauccaggagaaccccuggauggaggacaagacgccgguggagagcugggaggaggugcccuaccuggggaagcgcgaggaccaguggugcggcucccugaucgggcucaccagccgggccaccugggccaagaacauccagaccgccaucaaccagguccgcagccugaucggcaacgaggaguacacggacuacaugcccuccaugaagcgcuuccggcgcgaggaggaggaggcgggcgugcugugguga

SEQ ID NO: 9295 - RNA, 9876 nt, Artificial Sequence
  derived and/or modified CDS sequence (opt1) from DENV-2__EU482634__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuggccgagaacgaggugaagcucaccaucaugaccggcgacaucaaggggaucaugcaggcgggcaagcggucccugcgcccgcagcccaccgagcugaaguacagcuggaagacguggggcaaggccaagaugcucuccaccgagagccacaaccagaccuuccugaucgacgggcccgagaccgccgagugcccgaacacgaaccgggccuggaacucccuggaggucgaggacuacggcuucgggguguucaccaccaacaucuggcucaagcugcgcgagaagcaggacguguucugcgacagcaagcugauguccgccgcgaucaaggacaaccgggccguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgcggggcccgugagccagcacaacuaccgcccgggcuaccacacgcagaccgccgggcccuggcaccucggcaagcuggagauggacuucgaccugugcgaggggaccaccgugguggucacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccuguuccuggaggagaugcugcggacccgcaucggcacgaagcacgccauccuccugguggccguguccuucgucacccugaucaccgggaacaugagcuuccgggaccucggccgcgugauggugauggucggggccaccaugacggacgacaucggcaugggcgugaccuaccuggcccugcucgcggccuucaaggugcgccccaccuucgccgccgggcugcugcuccggaagcugaccuccaaggagcugaugauggccacgaucggcaucgcgcuccugagccaguccaccauccccgagaccauccuggagcucaccgacgcccuggcccuggggaugaugguccucaagaucgugcgcaacauggagaaguaccagcuggccgugacgaucauggccaucagcugcgucccgaacgcggugauccugcagaacgccuggaagguguccugcaccauccucgccgccgucagcgugagcccccugcugcucaccagcucccagcagaaggcggacuggaucccccuggcccugaccaucaagggccucaaccccacggccaucuuccugaccacccugagccggaccaacaagaagcgcuccuggccgcucaacgaggccaucauggccgucggcauggugagcauccuggcguccagccugcucaagaacgacauccccaugacggggccccugguggccggcgggcugcucaccgucugcuacgugcugaccggccgguccgccgaccuggagcucgagcgcgccgccgacgugaagugggaggaccaggcggagaucagcgggagcucccccauccugagcaucaccaucuccgaggacggcagcauguccaucaagaacgaggaggaggagcagacgcugaccauccucauccggaccggccugcuggucaucagcgggguguucccgguguccauccccaucaccgccgccgccugguaccucugggaggucaagaagcagcgcgccggcgugcugugggacgugcccuccccgccgcccgucgagaaggcggagcuggaggacggggccuaccggaucaagcagcgcggcauccucggguacucccagaucggcgccggcguguacaaggaggggaccuuccacacgauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccgggaucuucaagaccaacacgggcaccaucggggccgugagccucgacuucucccccggcaccagcggcucccccaucgucgaccggaaggggaagguggugggccuguacgggaacggcgucgugacccgcagcggcgccuacguguccgcgaucgcccagacggagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacccugauccucgcgccgacgcgcgugguggccgccgagauggaggaggcccugcggggccugcccauccgcuaccagacccccgccaucaagaccgagcacaccgggcgggagaucgucgaccucaugugccacgcgacguucaccaugcgccugcugucccccgugcgggugccgaacuacaaccucaucaucauggacgaggcccacuucaccgaccccgccagcaucgccgcccgcggcuacaucagcacccgggucgagaugggcgaggcggccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagacguucgacuccgaguacgugaagacccgggccaacgacugggacuucgucgugaccaccgacaucagcgagaugggcgccaacuucaaggcggagcgcgugaucgacccccggcgcugcaugaagcccgucauccucacggacggggaggagcgggugauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccaccuucaugacgcagaaggcccggaacgcccucgacaaccuggccgugcugcacaccgcggaggccgggggccgcgccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacgucgugaucgccauccugaccguggucgcggccaccauggccaacgagaugggcuuccuggagaagacgaagaaggaccucgggcugggcagcaucaccacccaggaguccgagagcaacauccuggacaucgaccuccgcccggccagcgccuggacccuguacgcgguggccacgaccuucgugacccccaugcugcggcacuccaucgagaacagcuccgucaacgugagccucaccgccaucgccaaccaggcgacggugcugaugggccuggggaagggcuggccccucuccaagauggacaucggggucccccugcuggccaucggcugcuacagccaggugaacccgaucacccucaccgccgcccugcugcuccugguggcccacuacgcgaucaucgggcccggccugcaggccaaggccacccgcgaggcccagaagcgggccgcggccggcaucaugaagaaccccacggucgacgggaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgcggugagcauggccaacaucuuccgcggcuccuaccuggccggcgccgggcuccucuucagcaucaugaagaacaccaccuccacgcgccggggcaccgggaacaucggcgagacccugggcgagaaguggaagucccgccugaacgcgcucgggaaguccgaguuccagaucuacaagaaguccggcauccaggaggucgaccggacccuggccaaggaggggaucaagcgcggcgagacggaccaccacgccgugucccgggggagcgccaagcugcgcugguucguggagcggaacauggucaccccggagggcaaggugguggaccucggcugcgggcgcggcgggugguccuacuacugcggcgggcugaagaacguccgggaggugaagggccugaccaagggcgggcccggccacgaggagcccauccccaugagcaccuacggguggaaccucgugcgccugcaguccggcgucgacguguucuucacgccgcccgagaagugcgacacccugcucugcgacaucggggagagcagccccaaccccaccaucgaggccggccggacccugcgcgugcugaaccucgucgagaacuggcugaacaacaacaccaaguucugcaucaaggugcugaacccguacaugcccuccgugaucgagaagauggaggcgcuccagcggaaguacggcggggcccugguccgcaacccccugagccggaacuccacgcacgagauguacugggugagcaacgccaccggcaacaucguguccagcgucaacaugaucucccgcaugcugaucaaccgguucaccaugaagcacaagaaggccaccuacgagccggacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggugaacggcgucgugcgccugcucaccaagcccugggacguggucccgauggugacccagauggccaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcgguccaacgccgcccugggggcgaucuucaccgacgagaacaaguggaaguccgcccgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacucccugagcggcguggagggggagggccugcaccgccucggcuacauccugcgggacgucagcaagaaggagggcggcgccauguacgccgacgacaccgcggggugggacacgcgcaucacccuggaggaccucaagaacgaggagauggugaccaaccacaugaagggcgagcacaagaagcuggccgaggccaucuucaagcugaccuaccagaacaaggucgugcgggugcagcgcccgacgccccgggggaccgucauggacaucaucucccgccgggaccagcgcggcagcggccagguggggaccuacggccucaacaccuucacgaacauggaggcccagcugauccgccagauggagggggagggcaucuucaaguccauccagcaccugaccgccaccgaggagaucgugguccagaacuggcucgcgcgggugggccgcgagcggcugagccgcauggccaucuccggggacgacugcguggucaagcccaucgacgaccgguucgccagcgcccugaccgcccucaacgacaugggcaaggugcgcaaggacauccagcagugggagcccucccggggguggaacgacuggacccaggucccguucugcagccaccacuuccacgagcuggucaugaaggacggccgcgugcuggugguccccugccggaaccaggacgagcucaucgggcgcgcgcggaucucccagggcgccggcuggagccugaaggagaccgccugccuggggaaguccuacgcccagauguggacccucauguacuuccaccgccgggaccugcgccuggccgcgaacgccaucugcagcgccgugcccucccacugggugcccaccagccggaccacgugguccauccacgccaagcacgaguggaugaccaccgaggacaugcucgcggucuggaaccgcguguggauccaggagaacccguggauggaggacaagacccccguggagagcugggaggagguccccuaccugggcaagcgggaggaccaguggugcgggucccugaucggccucacgagccgcgccaccugggccaagaacauccagaccgccaucaaccaggugcggagccugaucgggaacgaggaguacaccgacuacaugcccuccaugaagcgcuuccgccgggaggaggaggaggccggcgugcugugguga

SEQ ID NO: 9296 - RNA, 9876 nt, Artificial Sequence
  derived and/or modified CDS sequence (opt1) from DENV-2__EU482635__SS-prME
accgcgggcgucaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccuguccgaggagcaggacaagcgcuucaucugcaagcacagcaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacuccggggaggagcacgccgugggcaacgacaccgggaagcacggcaaggagaucaagaucaccccgcagagcuccaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacgcuggugaccuucaagaacccccacgcgaagaagcaggacgucgugguccucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgugaaggagaucgccgagacccagcacgggacgaucgugauccgcguccaguacgagggcgacggcagccccugcaagauccccuucgagaucaccgaccuggagaagcggcacgugcucgggcgccugaucaccgugaacccgaucgucaccgagaaggacucccccgugaacaucgaggcggagccgcccuucggcgacagcuacaucaucaucgggguggagccgggccagcugaagcucaacugguucaagaagggguccagcaucggccagauguucgagacgaccaugcgcggcgccaagcggauggccauccugggggacaccgccugggacuucggcucccucggcggggucuucaccagcaucgggaaggcccuccaccagguguucggggcgaucuacggcgccgccuucuccggggugagcuggacgaugaagauccugaucggcgucaucaucaccuggaucgggaugaacucccgcagcaccucccugagcgugucccuggugcucgucggcguggugacccuguaccugggggccaugguccaggcggacagcggcugcgugguguccuggaagaacaaggagcucaagugcggcagcgggaucuucaucacggacaacguccacaccuggaccgagcaguacaaguuccagcccgagagccccuccaagcuggccagcgccauccagaaggcccacgaggagggcaucugcgggauccgguccgugacccgccuggagaaccucauguggaagcagaucacgcccgagcugaaccacauccugagcgagaacgaggugaagcucaccaucaugaccggcgacauccgggggaucaugcaggccggcaagcgcucccugcggccgcagcccaccgagcugaaguacagcuggaagacguggggcaaggcgaagaugcucuccaccgagagccacaaccagaccuuccugaucgacgggcccgagaccgccgagugcccgaacacgaaccgcgccuggaacucccuggaggucgaggacuacggcuucgggguguucaccaccaacaucuggcucaagcugcgggagaagcaggacguguucugcgacagcaagcugauguccgccgccaucaaggacaaccgcgcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccuccgggaagcugaucacggaguggugcugccgcagcugcacccugcccccgcuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccggaucggcacgaagcacgcgauccuccugguggccguguccuucgucacccugaucaccgggaacaugagcuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccuccaaggagcugaugauggccacgaucggcaucgcccuccugagccaguccaccauccccgagaccauccuggagcucaccgacgcgcuggcccuggggaugaugguccucaagaucgugcggaacauggagaaguaccagcuggccgugacgaucauggccaucagcugcgucccgaacgccgugauccugcagaacgcguggaagguguccugcaccauccucgccgccgucagcgugagcccccugcugcucaccagcucccagcagaaggccgacuggaucccccuggcgcugaccaucaagggccucaaccccacggccaucuuccugaccacccugagccgcaccuccaagaagcggagcuggccgcucaacgaggccaucauggccgucggcaugguguccauccuggccagcagccugcucaagaacgacauccccaugacggggccccugguggcgggcgggcugcucaccgucugcuacgugcugaccggccgcuccgccgaccuggagcucgagcgggccgccgacgugaagugggaggaccaggccgagaucagcggguccagccccauccuguccaucaccaucagcgaggacggcuccaugagcaucaagaacgaggaggaggagcagacgcugaccauccucauccgcaccggccugcuggucaucuccgggguguucccggugagcauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacagccagaucggcgccggcguguacaaggaggggaccuuccacacgauguggcacgugacccgcggcgccguccugaugcaccgggggaagcgcaucgagcccuccugggccgacgugaagaaggaccugaucagcuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugucccucgacuucagccccggcaccuccggcagccccaucgucgaccgcaaggggaagguggugggccuguacgggaacggcgucgugacccgguccggcgccuacgugagcgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugucccccgugcgcgugcccaacuacaaccucaucaucauggacgaggcgcacuucaccgacccggccagcaucgccgcccggggcuacaucuccacgcgcgucgagaugggcgaggccgcggggaucuucaugaccgccacgccgcccggcagccgggaccccuucccgcaguccaacgcccccaucauggacgaggagcgcgagauccccgagcggagcuggaacuccgggcacgagugggugaccgacuucaagggcaagacggugugguucguccccagcaucaaggccgggaacgacaucgcggccugccugcgcaagaacggcaagaaggugauccagcugucccggaagaccuucgacagcgaguacgugaagacccgcgccaacgacugggacuucgucgugaccacggacaucuccgagaugggcgccaacuucaaggccgagcgggugaucgacccgcgccggugcaugaagcccgucauccucaccgacggggaggagcgcgugauccuggcgggccccaugcccgugacccacagcuccgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccagcauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacuccgacccgcucgcccugaaggaguucaaggaguucgccgcgggccgcaagagccugacccucaaccugaucaccgagaugggccggcugcccacguucaugacccagaaggcccgcaacgcccucgacaaccuggccgugcugcacaccgccgaggccggcgggcgggccuacaaccacgcccucuccgagcugcccgagacccuggagacgcuccugcugcucacccugcuggccaccgucaccggcgggaucuuccucuuccugaugagcgggaaggggaucggcaagaugacccuggggaugugcugcaucaucacggccuccauccuccugugguacgcgcagauccagccccacuggaucgccgccagcaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggaguccgagagcaacauccuggacaucgaccuccggcccgccuccgccuggacgcuguacgccguggcgaccaccuucgugaccccgaugcugcgccacagcaucgagaacuccagcgucaacgugucccucacggccaucgccaaccaggccaccgugcugaugggccuggggaagggcuggccccucagcaagauggacaucggggucccccugcuggcgaucggcugcuacucccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucagcacgcucugggagggcaaccccgggcgcuucuggaacaccaccaucgccguguccauggcgaacaucuuccgcggcagcuaccuggccggcgccgggcuccuguucuccaucaugaagaacaccacgagcacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccaugagcacguacggguggaaccucgugcggcugcaguccggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucagccgcgggaacucccugagcggcguggagggggagggccugcaccggcucggcuacauccugcgcgacgucuccaagaaggagggcggcgccauguacgccgacgacacggccgggugggacacccggaucacccuggaggaccucaagaacgaggagauggugaccaaccacaugaagggcgagcacaagaagcuggcggaggccaucuucaagcugacguaccagaacaaggucgugcgcgugcagcggcccaccccgcgcgggaccgucauggacaucaucagccggcgcgaccagcgcggcuccggccagguggggaccuacggccucaacacguucaccaacauggaggcccagcugauccggcagauggagggggagggcaucuucaagagcauccagcaccugaccgccaccgaggagaucgccgugcagaacuggcucgcgcgcgucggccgggagcgccugucccggauggccaucagcggggacgacugcguggugaagcccaucgacgaccgcuucgccuccgcccugacggcccucaacgacaugggcaagguccggaaggacauccagcagugggagcccagccgcggguggaacgacuggacccaggugcccuucugcucccaccacuuccacgagcuggugaugaaggacggccggguccugguggugccgugccgcaaccaggacgagcucaucgggcgggcgcgcaucagccagggcgccggcuggucccugaaggagaccgccugccugggcaagagcuacgcccagauguggacccucauguacuuccaccggcgcgaccugcggcuggccgcgaacgccaucugcuccgccguccccagccacugggugcccaccucccgcacgaccuggagcauccacgccaagcacgaguggaugaccaccgaggacaugcucgcgguguggaaccgggucuggauccaggagaaccccuggauggaggacaagacgccgguggagagcugggaggaggugcccuaccugggcaagcgcgaggaccaguggugcgggucccugaucggccucaccagccgggccaccugggccaagaacauccagaccgccaucaaccagguccgcucccugaucgggaacgaggaguacacggacuacaugcccagcaugaagcgcuuccggcgcgaggaggaggaggccggcgugcugugguga

SEQ ID NO: 9297 - RNA, 9876 nt, Artificial Sequence
  derived and/or modified CDS sequence (opt1) from DENV-2__GQ199874__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcucccugaucgggcucaccagccgggccaccugggccaagaacauccagaccgccaucaaccagguccgcagccugaucggcaacgaggaguacacggacuacaugcccuccaugaagcgcuuccggcgcgaggaggaggaggccggcgugcugugguga

SEQ ID NO: 9298 - RNA, 9876 nt, Artificial Sequence
  derived and/or modified CDS sequence (opt1) from DENV-2__EU482639__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccacccuggugaccccgaugcuccgccacuccaucgagaacagcuccgucaacgugagccugacggccaucgccaaccaggccaccgugcugaugggccucgggaagggcuggccccuguccaagauggacaucggggucccccugcucgcgaucggcugcuacagccaggugaaccccaucacccugaccgccgcccugcuccugcugguggcccacuacgccaucaucgggccgggccuccaggcgaaggccacgcgggaggcccagaagcgcgccgccgcgggcaucaugaagaaccccaccgucgacgggaucaccgugaucgaccuggagcccauccccuacgacccgaaguucgagaagcagcugggccaggugaugcuccugauccugugcgucacccaggugcucaugaugcggacgaccugggcccugugcgaggcccugacccucgccaccgggcccaucuccacgcugugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcucaacgcccugggcaagagcgaguuccagaucuacaagaaguccggcauccaggaggucgaccgcacgcuggcgaaggaggggaucaagcggggcgagaccgaccaccacgccgugagccgcggguccgccaagcuccggugguucguggagcgcaacauggucacccccgagggcaaggugguggaccugggcugcgggcggggcggguggagcuacuacugcggcgggcugaagaacguccgcgaggugaagggccucaccaagggcgggccgggccacgaggagcccauccccauguccacguacggguggaaccuggugcggcugcagagcggcgucgacguguucuucacgccgcccgagaagugcgagacccuccugugcgacaucggggagagcucccccaaccccaccaucgaggccggccgcacccugcgggugcucaaccuggucgagaacuggcugaacaacaacacgcaguucugcaucaaggugcucaaccccuacaugcccagcgugaucgagaagauggaggcccugcagcgcaaguacggcggggcgcugguccggaacccccugucccgcaacagcacccacgagauguacuggguguccaacgccaccggcaacaucgugagcuccgucaacaugaucagccggaugcucaucaaccgcuucaccaugaagcacaagaaggccacguacgagcccgacguggaccugggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccuccugaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcucuggaaggagcugggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcucgucgaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcguggagggggagggccuccaccggcugggcuacauccugcgcgacgucgggaagaaggagggcggggccauguacgccgacgacacggccggcugggacacccggaucacccucgaggaccugaagaacgaggagauggugaccaaccacaugaagggggagcacaagaagcuggcggaggccaucuucaagcucacguaccagaacaaggucgugcgcgugcagcggcccaccccgcgcggcaccgucauggacaucaucucccggcgcgaccagcgcggcagcgggcaggucggcaccuacgggcugaacacguucaccaacauggaggcccagcugauccggcagauggagggcgagggcaucuucaaguccauccagcaccucaccgccaccgaggagaucgccgugcagaacuggcuggcgcgcgucgggcgggagcgccugagccggauggccaucuccggcgacgacugcguggugaagcccaucgacgaccgcuucgccagcgcccucacggcccugaacgacauggggaagauccggaaggacauccagcagugggagcccucccgcggcuggaacgacuggacccagguccccuucugcagccaccacuuccacgagcuggugaugaaggacgggcgggugcucgucgugccgugccgcaaccaggacgagcugaucggccgggcgcgcaucucccagggcgccggguggagccugaaggagaccgccugccucggcaaguccuacgcccagauguggacccugauguacuuccaccggcgcgaccugcggcucgccgcgaacgccaucugcagcgccgugcccucccacuggguccccaccagccgcacgaccugguccauccacgccaagcacgaguggaugaccaccgaggacaugcuggcgguguggaaccggguguggauccaggagaaccccuggauggaggacaagacgccggucgagagcugggaggaggugcccuaccuggggaagcgcgaggaccaguggugcggcucccucaucgggcugaccagccgggccaccugggccaagaacauccagaccgccaucaaccaggugcgcagccugaucggcaacgaggaguacacggacuacaugcccuccaugaagcgcuuccggcgcgaggaggaggaggccggcguccucugguga

SEQ ID NO: 9299 - RNA, 9876 nt, Artificial Sequence
  derived and/or modified CDS sequence (opt1) from DENV-2__EU482766__SS-prME
accgcgggcgugaucgucaugcugauccccaccgccauggcguuccaccucaccacccggaacggggagccccacaugaucgugggccggcaggagaagggcaagagccugcuguucaagaccgaggacggggugaacaugugcacccucauggccaucgaccugggggagcugugcgaggacaccaucaccuacaagugcccccuccugcgccagaacgagcccgaggacaucgacugcuggugcaacuccaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcuccagccgcaccggccucgacuucaacgagaugguccugcugcagauggaggacaaggccuggcucgugcaccggcagugguuccuggaccugccccuccccuggcugcccggggccgacacccagggcuccaacuggauccagaaggagacgcuggugaccuucaagaacccgcacgcgaagaagcaggacgucgugguccucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgugaaggagaucgccgagacccagcacgggacgaucgugauccgcguccaguacgagggcgacggcagccccugcaagauccccuucgagaucaccgaccuggagaagcggcacgugcucgggcgccugaucaccgugaaccccaucgucaccgagaaggacuccccggugaacaucgaggcggagccgcccuucggcgacagcuacaucaucaucgggguggagcccggccagcugaagcucaacugguucaagaagggguccagcaucggccagauguucgagacgaccaugcgcggcgccaagcggauggccauccugggggacaccgccugggacuucggcucccucgggggcgucuucaccagcaucgggaaggcccuccaccagguguucggcgcgaucuacggcgccgccuucuccggggugagcuggacgaugaagauccugaucggcgucaucaucaccuggaucgggaugaacucccgcagcaccucccugagcgugucccuggugcucgucggcguggugacccuguaccugggggccgucgugcaggcggacagcggcugcguggucuccuggaagaacaaggagcucaagugcggcagcgggaucuucaucacggacaacgugcacaccuggaccgagcaguacaaguuccagccggagagccccuccaagcuggccagcgccauccagaaggcccacgaggagggcaucugcgggauccgguccgugacccgccuggagaaccucauguggaagcagaucacgcccgagcugaaccacauccugagcgagaacgaggucaagcucaccaucaugaccggcgacaucaaggggaucaugcaggccggcaagcggucccugcgcccccagccgaccgagcugaaguacagcuggaagacguggggcaaggcgaagaugcucuccaccgagagccacaaccagaccuuccugaucgacgggcccgagaccgccgagugccccaacacgaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggccgaagucccacacccuguggagcaacggcgugcuggaguccgagaugaucauccccaagaacuucgccgggcccgugagccagcacaacuaccgccccggcuaccacacgcagaccgcggggccguggcaccucggcaagcuggagauggacuucgacuucugcgaggggaccaccguggucgugacggaggacugcggcaaccggggccccagccugcgcaccaccaccgccuccgggaagcucaucacggaguggugcugccggagcugcacccugccgccccugcgcuaccggggcgaggacgggugcugguacggcauggagauccgcccgcucaaggagaaggaggagaaccuggugaacucccuggucaccgccgggcacggccagaucgacaacuucagccucggcgugcuggggauggcccuguuccucgaggagaugcugcggacccgcaucggcacgaagcacgcgauccugcucguggccgucuccuucgugacccugaucaccgggaacaugagcuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccuccaaggagcugaugauggccacgaucggcaucgcccugcucagccaguccaccauccccgagaccauccuggagcugaccgacgcgcucgcccuggggaugauggugcugaagaucgugcgcaacauggagaaguaccagcucgccgucacgaucauggccaucagcugcgugcccaacgccgugauccugcagaacgcguggaaggucuccugcaccauccuggccgccgugagcgucuccccgcuccugcugaccagcucccagcagaaggccgacuggaucccccucgcgcugaccaucaagggccugaaccccacggccaucuuccucaccacccugagccggaccuccaagaagcgcagcuggccccugaacgaggccaucauggccgugggcaugguguccauccucgccagcagccugcugaagaacgacaucccgaugacggggccccucgucgcgggcgggcugcugaccgugugcuacgugcucaccggccgguccgccgaccuggagcuggagcgcgccgccgacgucaagugggaggaccaggccgagaucagcggguccagccccauccucuccaucaccaucagcgaggacggcuccaugagcaucaagaacgaggaggaggagcagacgcugaccauccugauccggaccggccuccuggugaucuccgggguguuccccgucagcaucccgaucaccgcggccgccugguaccugugggaggugaagaagcagcgcgccggcgugcucugggacguccccagcccgccgcccguggagaaggccgagcuggaggacggggcguaccggaucaagcagcgcggcauccugggguacagccagaucggcgccggcguguacaaggaggggaccuuccacacgauguggcacgucacccggggcgccgugcucaugcaccgcgggaagcggaucgagcccuccugggccgacgugaagaaggaccugaucagcuacggcgggggcuggaagcuggagggcgaguggaaggagggggaggagguccaggugcucgcccuggagcccggcaagaacccccgcgcggugcagaccaagcccgggaucuucaagaccaacacgggcaccaucggggccgucucccuggacuucagccccggcaccuccggcagccccaucguggaccggaaggggaagguggucggccucuacgggaacggcguggugacccgcuccggcgccuacgucagcgccaucgcgcagacggagaaguccaucgaggacaacccggagaucgaggacgacaucuuccggaagaagcgccugaccaucauggaccugcaccccggggccggcaagaccaagcgguaccuccccgccaucgugcgcgaggccaucaagcgggggcugcgcacccugauccuggcccccacgcgcguggucgcggccgagauggaggaggcccuccggggccugccgauccgcuaccagacccccgccaucaagaccgagcacaccgggcgggagaucguggaccugaugugccacgccacguucaccaugcgccuccugucccccgugcggguccccaacuacaaccugaucaucauggacgaggcgcacuucaccgacccggccagcaucgccgcccgcggcuacaucuccacccggguggagaugggcgaggccgcggggaucuucaugacggccacgccgcccggcagccgcgaccccuucccgcaguccaacgcccccaucauggacgaggagcgggagauccccgagcgcagcuggaacuccgggcacgagugggugaccgacuucaagggcaagaccgucugguucgugcccagcaucaaggccgggaacgacaucgcggccugccuccggaagaacggcaagaaggugauccagcugucccgcaagacguucgacagcgaguacgucaagacccgggccaacgacugggacuucguggugaccaccgacaucuccgagaugggcgccaacuucaaggccgagcgcgucaucgacccgcggcgcugcaugaagcccgugauccugacggacggggaggagcgggugauccucgcgggccccaugcccgucacccacagcuccgccgcccagcgccgggggcgcaucggccgcaacccgaagaacgagaacgaccaguacaucuacaugggggagccccuggagaacgacgaggacugcgcccacuggaaggaggccaagaugcugcucgacaacaucaacacccccgagggcaucauccccagcauguucgagccggagcgggagaagguggacgcgaucgacggcgaguaccgccugcgcggggaggcccgcaagaccuucguggaccugaugcggcgcggcgaccuccccgucuggcuggccuacaagguggccgccgaggggaucaacuacgcggaccggaaguggugcuucgacggcaucaagaacaaccagauccuggaggagaacauggagguggagaucuggacgaaggagggggagcgcaagaagcucaagccccgguggcuggacgcccgcaucuacuccgacccgcuggcccucaaggaguucaaggaguucgccgcgggccgcaagagccugacccugaaccucaucaccgagaugggccgccugcccaccuucaugacgcagaaggcccggaacgcccuggacaaccucgccguccugcacaccgccgaggccgggggccgcgccuacaaccacgcccuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcgcagauccagccccacuggaucgccgccagcaucauccuggaguucuuccugaucguccuccugaucccggagcccgagaagcagcggacgccccaggacaaccagcugaccuacguggugaucgccauccucaccgucguggccgcgaccauggccaacgagaugggcuuccuggagaagacgaagaaggaccuggggcucggcagcaucaccacccaggaguccgagagcaacauccuggacaucgaccugcgccccgccuccgccuggacccucuacgccguggcgacgaccuucgucaccccgaugcugcggcacagcaucgagaacuccagcgugaacgugucccugaccgccaucgccaaccaggccacgguccucaugggccuggggaagggcuggccccugagcaagauggacaucggggugccccuccuggcgaucggcugcuacucccaggugaaccccaucacccugaccgccgcccuccugcugcucgucgcccacuacgccaucaucgggccgggccugcaggcgaaggccacccgcgaggcccagaagcgggccgccgcgggcaucaugaagaaccccacgguggacgggaucaccgugaucgaccuggagcccauccccuacgacccgaaguucgagaagcagcucggccaggucaugcugcugauccucugcgugacccaggugcugaugaugcgcaccacgugggcccugugcgaggcccucacccuggccaccgggcccaucagcacccugugggagggcaaccccgggcgguucuggaacacgaccaucgccgucuccauggcgaacaucuuccgcggcagcuaccucgccggcgccgggcugcuguucuccaucaugaagaacaccaccagcacgcgccggggcaccgggaacaucggcgagacccucggcgagaaguggaagucccgccugaacgcccugggcaagagcgaguuccagaucuacaagaaguccggcauccaggagguggaccggacccucgcgaaggaggggaucaagcgcggcgagacggaccaccacgccgugagccggggguccgccaagcugcgcugguucgucgagcggaacauggugacccccgagggcaagguggucgaccugggcugcgggcgcggcggguggagcuacuacugcggcgggcucaagaacgugcgggaggugaagggccugaccaagggcgggccgggccacgaggagcccauccccaugagcaccuacggguggaaccugguccgccuccaguccggcguggacguguucuucacgcccccggagaagugcgacacccugcugugcgacaucggggagagcucccccaaccccaccaucgaggccggccggacccuccgcguccugaaccugguggagaacuggcucaacaacaacacccaguucugcaucaaggugcugaaccccuacaugccgagcgucaucgagaagauggaggcccugcagcggcaguacggcggggcgcucgugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagcccgacguggaccugggguccggcacgcgcaacaucgggaucgagagcgagaucccgaaccucgacaucaucggcaagcggaucgagaagaucaagcaggagcacgagaucuccuggcacuacgaccaggaccaccccuacaagaccugggccuaccacggcagcuacgagaccaagcagaccggguccgccagcuccauggucaacggcguggugcgccugcugacgaagcccugggacgucgugcccauggugacccagauggcgaugaccgacaccacgccguucgggcagcagcgcgucuucaaggagaagguggacacccggacccaggagcccaaggagggcaccaagaagcucaugaagaucacggccgaguggcuguggaaggagcugggcaagaagaagacgccccggaugugcacccgggaggaguucacccgcaaggugcggagcaacgccgcccucggggccaucuucacggacgagaacaaguggaaguccgcgcgcgaggccgucgaggacggccgguucugggagcugguggaccgcgagcggaaccugcaccucgaggggaagugcgagaccugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucagccgggggaacucccucagcggcgucgagggggagggccugcaccgccugggcuacauccuccgggacguggggaagaaggagggcggggccauguacgccgacgacaccgccggcugggacacccgcaucacgcuggaggaccugaagaacgaggagauggucaccaaccacaugaagggggagcacaagaagcucgcggaggccaucuucaagcugaccuaccagaacaagguggugcggguccagcgccccaccccgcggggcacggugauggacaucaucucccgccgggaccagcgcggcagcgggcaggucggcaccuacgggcugaacaccuucaccaacauggaggcccagcucauccgccagauggagggcgagggcaucuucaaguccauccagcaccugacggccaccgaggagaucgccguccagaacuggcuggcgcggguggggcgcgagcggcucagccgcauggccaucuccggcgacgacugcguggucaagcccaucgacgaccgguucgccagcgcccugaccgcccugaacgacauggggaaggugcgcaaggacauccagcagugggagcccucccggggcuggaacgacuggacccaggugcccuucugcagccaccacuuccacgagcucgucaugaaggacgggcgcgugcugguggucccgugccggaaccaggacgagcugaucggccgcgcgcggaucucccagggcgccggguggagccucaaggagacggccugccugggcaaguccuacgcccagauguggacccugauguacuuccaccgccgggaccuccgccuggccgcgaacgccaucugcagcgccgugcccucccacugggugcccaccagccggaccaccugguccauccacgccaagcacgaguggaugacgaccgaggacaugcuggcggucuggaaccgcguguggauccaggagaaccccuggauggaggacaagaccccgguggagagcugggaggagguccccuaccucgggaagcgggaggaccaguggugcggcagccugaucgggcugaccucccgcgccacgugggccaagaacauccagaccgccaucaaccaggugcggagccucaucggcaacgaggaguacaccgacuacaugcccuccaugaagcgcuuccgccgggaggaggaggaggccggcgugcugugguga

SEQ ID NO: 9300 - RNA, 9876 nt, Artificial Sequence
  derived and/or modified CDS sequence (opt1) from DENV-2__EU482695__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcucccugaucgggcucaccagccgggccaccugggccaagaacauccagaccgccaucaaccagguccgcagccugaucggcaacgaggaguacacggacuacaugcccuccaugaagcgcuuccggcgcgaggaggaggaggccggcgugcugugguga

SEQ ID NO: 9301 - RNA, 9876 nt, Artificial Sequence
  derived and/or modified CDS sequence (opt1) from DENV-2__EU482769__SS-prME
accgcgggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacauccgggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcgcacccugauccucgccccgacgcgggugguggcggccgagauggaggaggcccugcgcggccugcccauccgguaccagaccaccgccaucaagaccgagcacacggggcgcgagaucgucgaccucaugugccacgccaccuucaccaugcggcugcugagccccgugcgcgugcccaacuacaaccucaucaucauggacgaggcgcacuucaccgacccggccuccaucgccgcccggggcuacaucagcacgcgcgucgagaugggcgaggccgcggggaucuucaugaccgccacgccgcccggcucccgggaccccuucccgcagagcaacgcccccaucauggacgaggagcgcgagauccccgagcgguccuggaacagcgggcacgagugggugaccgacuucaagggcaagacggugugguucguccccuccaucaaggccgggaacgacaucgcggccugccugcgcaagaacggcaagaaggugauccagcugagccggaagaccuucgacuccgaguacgugaagacccgcgccaacgacugggacuucgucgugaccacggacaucagcgagaugggcgccaacuucaaggccgagcgggugaucgacccgcgccggugcaugaagcccgucauccucaccgacggggaggagcgcgugauccuggcgggccccaugcccgugacccacuccagcgccgcccagcggcgcgggcgcaucggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaaggucgacgcgaucgacggcgaguaccggcugcgcggggaggcccggaagacguucguggaccucaugcgccggggcgaccugcccguguggcuggccuacaaggucgccgccgaggggaucaacuacgcggaccgcaaguggugcuucgacggcaucaagaacaaccagauccucgaggagaacauggagguggagaucuggaccaaggagggggagcggaagaagcugaagccccgcuggcuggacgcccggaucuacagcgacccgcucgcccugaaggaguucaaggaguucgccgcgggccgcaagucccugacccucaaccugaucaccgagaugggccggcugcccacguucaugacccagaaggcccgcaacgcccucgacaaccuggccgugcugcacaccgccgaggccgggggccgggccuacaaccacgcccucagcgagcugcccgagacccuggagacgcuccugcugcucacccugcuggccaccgucaccgggggcaucuuccucuuccugauguccggcaaggggaucggcaagaugacccuggggaugugcugcaucaucacggccagcauccuccugugguacgcgcagauccagccccacuggaucgccgccuccaucauccuggaguucuuccucaucgugcugcugaucccggagcccgagaagcagcgcacgccccaggacaaccagcucaccuacgucgugaucgccauccugaccguggucgccgcgacgauggccaacgagaugggcuuccuggagaagaccaagaaggaccucgggcugggcagcaucaccacccaggagagcgaguccaacauccuggacaucgaccuccggcccgccagcgccuggacgcuguacgccguggcgaccaccuucgugaccccgaugcugcgccacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaaccccaucacccucaccgccgcccugcugcuccugguggcccacuacgccaucaucgggccgggccugcaggcgaaggccacgcgggaggcccagaagcgcgccgccgcgggcaucaugaagaaccccaccgucgacgggaucaccgugaucgaccucgagcccauccccuacgacccgaaguucgagaagcagcugggccaggugaugcugcucauccugugcgucacccaggugcugaugaugcggacgaccugggcccucugcgaggcccugacccuggccaccgggcccaucuccacgcucugggagggcaaccccgggcgcuucuggaacaccaccaucgccgugagcauggcgaacaucuuccgcggcuccuaccuggccggcgccgggcuccuguucagcaucaugaagaacaccacgaacacccggcgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggccgggccacgaggagcccauccccauguccacguacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacgcaguucugcaucaaggugcugaaccccuacaugcccagcgugaucgagaagauggaggcccuccagcgcaaguacggcggggcgcugguccggaacccccugucccgcaacagcacccacgagauguacuggguguccaacgccaccggcaacaucgugagcuccgucaacaugaucagccggaugcugaucaaccgcuucaccaugaagcacaagaaggccacguacgagcccgacguggaccucggguccggcacccggaacaucgggaucgagagcgagaucccgaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugguccccauggugacccagauggcgaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcccugggggccaucuucaccgacgagaacaaguggaaguccgcgcgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacacggccggcugggacacccggaucacccuggaggaccucaagaacgaggagauggugaccaaccacaugaagggggagcacaagaagcuggcggaggccaucuucaagcugacguaccagaacaaggucgugcgcgugcagcggcccaccccgcgcggcaccgucauggacaucaucucccggcgcgaccagcgcggcagcgggcaggucggcaccuacgggcucaacacguucaccaacauggaggcccagcugauccggcagauggagggcgagggcaucuucaaguccauccagcaccugaccgccaccgaggagaucgccgugcagaacuggcucgcgcgcgucgggcgggagcgccugagccggauggccaucuccggcgacgacugcguggugaagcccaucgacgaccgcuucgccagcgcccugacggcccucaacgacauggggaagguccggaaggacauccagcagugggagcccucccgcggcuggaacgacuggacccaggugcccuucugcagccaccacuuccacgagcuggugaugaaggacgggcggguccugguggugccgugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaaccccuggauggaggacaagacgccgguggagagcugggaggaggugcccuaccuggggaagcgcgaggaccaguggugcggcuccaugaucgggcugaccagccgggccaccugggccaagaacauccagaccgccaucaaccagguccgcagccucaucggcaacgaggaguacaucgacuacaugcccuccaugaagcgcuuccggcgcgaggaggaggaggccggcgugcugugguga

SEQ ID NO: 9302 - RNA, 9876 nt, Artificial Sequence
  derived and/or modified CDS sequence (opt1) from DENV-2__EU482696__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggccagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgcgaucaaggacaaccgggccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgcggggcccgugucccagcacaacuaccgcccgggcuaccacacgcagaccgccgggcccuggcaccucggcaagcuggagauggacuucgaccugugcgaggggaccaccgucguggugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccuguuccuggaggagaugcugcggacccgcaucggcacgaagcacgccacccuccuggucgccgugagcuucgugacccugaucaccgggaacauguccuuccgggaccucggccgcgucauggugauggugggggccacgaugaccgacgacaucggcaugggcgucaccuaccuggcccugcucgcggccuucaaggugcgccccaccuucgccgccgggcugcugcuccggaagcugacgagcaaggagcugaugauggccaccaucggcaucgcgcuccugucccagagcaccauccccgagaccauccuggagcucacggacgcccuggcccuggggaugauggugcucaagaucguccgcaacauggagaaguaccagcuggccgugaccaucauggccaucuccugcgugccgaacgcggucauccugcagaacgccuggaaggugagcugcaccauccucgccgccguguccgucagcccccugcugcucaccuccagccagcagaaggcggacuggaucccccuggcccugacgaucaagggccucaaccccaccgccaucuuccugaccacccugucccggacgagcaagaagcgcuccuggccgcucaacgaggccaucauggccgugggcauggucagcauccuggcguccagccugcucaagaacgacauccccaugaccgggccccugguggccggcgggcugcucaccgugugcuacguccugaccggccggagcgccgaccuggagcucgagcgcgccgccgacgugaagugggaggaccaggcggagaucuccgggagcucccccauccugagcaucacgaucuccgaggacggcagcauguccaucaagaacgaggaggaggagcagacccugaccauccucauccggaccggccugcuggugaucagcggggucuucccgguguccauccccaucaccgccgccgccugguaccucugggaggugaagaagcagcgcgccggcguccugugggacgugcccagcccgccgcccguggagaaggcggagcuggaggacggggccuaccggaucaagcagcgcggcauccucggguacucccagaucggcgccggcgucuacaaggaggggacguuccacaccauguggcacgugacccggggcgccgugcugaugcaccgcgggaagcggaucgagcccagcugggccgacgucaagaaggaccugaucuccuacggcgggggcuggaagcucgagggcgaguggaaggagggggaggagguccaggugcuggcgcuggagcccggcaagaacccccgcgccguccagaccaagcccgggacguucaagaccaacaccggcaccaucggggccgugagccucgacuucucccccggcacgagcggcucccccaucguggaccggaaggggaaggucgugggccuguacgggaacggcguggucacccgcagcggcgccuacguguccgcgaucgcccagaccgagaaguccaucgaggacaaccccgagaucgaggacgacaucuuccggaagaagcgccugaccaucauggaccuccaccccggggccggcaagacgaagcgguaccugcccgccaucgugcgcgaggccaucaagcgggggcugcgcacccugauccucgcgccgacccgcgucguggccgccgagauggaggaggcccugcggggccugcccauccgcuaccagacccccgccaucaagacggagcacaccgggcgggagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcucccgcgacccguucccccagagcaacgcccccaucauggacgaggagcgggagauccccgagcgcuccuggaacagcgggcacgagugggucacggacuucaagggcaagaccgugugguucgugccguccaucaaggcggggaacgacaucgccgccugccugcggaagaacggcaagaaggucauccagcugagccgcaagaccuucgacuccgaguacgugaagacccgggccaacgacugggacuucguggucacgaccgacaucagcgagaugggcgccaacuucaaggcggagcgcgugaucgacccccggcgcugcaugaagcccgugauccucaccgacggggaggagcgggucauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccguccauguucgagcccgagcgggagaagguggacgccaucgacggcgaguaccgccugcgcggggaggcccgcaagaccuucgucgaccucaugcggcgcggcgaccugcccguguggcuggccuacaagguggccgcggaggggaucaacuacgccgaccggaaguggugcuucgacggcaucaagaacaaccagauccucgaggagaacauggaggucgagaucuggaccaaggagggggagcgcaagaagcugaagccgcgguggcuggacgcccgcaucuacagcgacccccucgcccugaaggaguucaaggaguucgcggccggccggaagucccugacccucaaccugaucacggagaugggccgccugcccaccuucaugacccagaaggcccggaacgcccucgacaaccuggccgugcugcacaccgcggaggccgggggccgcgccuacaaccacgcccucagcgagcugcccgagacgcuggagacccuccugcugcucacccugcuggccaccgugaccgggggcaucuuccucuuccugauguccggcaaggggaucggcaagaugacgcuggggaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucaccuacguggucaucgccauccugacggugguggcggccaccauggccaacgagaugggcuuccuggagaagaccaagaaggaccucgggcugggcagcaucaccacgcaggagagcgaguccaacauccuggacaucgaccuccgcccggccagcgccuggacccuguacgcggucgccaccaccuucgugacgcccaugcugcggcacuccaucgagaacagcuccgugaacgucagccucaccgccaucgccaaccaggcgaccgugcugaugggccuggggaagggcuggccccucuccaagauggacaucggggugccccugcuggccaucggcugcuacagccaggucaacccgaucacccucacggccgcccugcugcuccugguggcccacuacgcgaucaucgggcccggccugcaggccaaggccacccgcgaggcccagaagcgggccgcggccggcaucaugaagaaccccaccguggacgggaucaccgucaucgaccucgagcccaucccguacgaccccaaguucgagaagcagcugggccaggugaugcugcucauccugugcgugacgcagguccugaugaugcgcaccaccugggcccucugcgaggcccugacccuggccacggggcccaucuccacccucugggagggcaaccccgggcgguucuggaacaccaccaucgcggugagcauggccaacaucuuccgcggcuccuaccuggccggcgccgggcuccucuucagcaucaugaagaacacgaccuccacccgccggggcaccgggaacaucggcgagacgcugggcgagaaguggaagucccgccugaacgcgcucgggaaguccgaguuccagaucuacaagaaguccggcauccaggagguggaccggacccuggccaaggaggggaucaagcgcggcgagaccgaccaccacgccgucucccgggggagcgccaagcugcgcugguucguggagcggaacauggugaccccggagggcaaggucguggaccucggcugcgggcgcggcgggugguccuacuacugcggcgggcugaagaacgugcgggaggucaagggccugacgaagggcgggcccggccacgaggagcccauccccaugagcaccuacggguggaaccucgugcgccugcagagcggcguggacgucuucuucaccccgcccgagaagugcgacacccugcucugcgacaucggggaguccagccccaaccccaccaucgaggccggccggacgcugcgcgugcugaaccucguggagaacuggcugaacaacaacacccaguucugcaucaagguccugaacccguacaugcccuccgugaucgagaagauggaggcgcuccagcggaaguacggcggggcccuggugcgcaacccccugagccggaacuccacccacgagauguacugggucagcaacgccaccggcaacaucguguccagcgugaacaugaucucccgcaugcugaucaaccgguucacgaugaagcacaagaaggccaccuacgagccggacgucgaccucgggagcggcacccgcaacaucgggaucgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgcguccagcauggugaacggcgugguccgccugcucaccaagcccugggacguggugccgauggucacgcagauggccaugaccgacaccacccccuucgggcagcagcgcguguucaaggagaagguggacacgcggacccaggagcccaaggagggcaccaagaagcugaugaagaucaccgccgaguggcuguggaaggagcucggcaagaagaagacgccccgcaugugcacccgggaggaguucacccgcaagguccgguccaacgccgcccugggggcgaucuucaccgacgagaacaaguggaaguccgcccgcgaggccguggaggacggccgguucugggagcugguggaccgcgagcggaaccuccaccuggaggggaagugcgagacgugcgucuacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacagccuguccggcguggagggggagggccugcaccgccucggcuacauccugcgggacgugagcaagaaggagggcggcgccauguacgccgacgacaccgcggggugggacacccgcaucacccuggaggaccucaagaacgaggagauggucacgaaccacaugaagggcgagcacaagaagcuggccgaggccaucuucaagcugaccuaccagaacaaggugguccgggugcagcgcccgacgccccgggggaucgugauggacaucaucucccgccgggaccagcgcggcagcggccaggucgggaccuacggccucaacacguucaccaacauggaggcccagcugauccgccagauggagggggagggcaucuucaaguccauccagcaccugaccgccgcggaggagaucguggugcagaacuggcucgcccgggucggccgcgagcggcugagccgcauggccaucuccggggacgacugcguggugaagcccaucgacgaccgguucgccagcgcccugaccgcgcucaacgacaugggcaagguccgcaaggacauccagcagugggagcccucccggggguggaacgacuggacccaggugccguucugcagccaccacuuccacgagcuggugaugaaggacggccgcguccugguggugcccugccggaaccaggacgagcucaucgggcgcgcccggaucucccagggcgccggcuggagccugaaggagaccgccugccuggggaaguccuacgcccagauguggacccucauguacuuccaccgccgggaccugcgccuggcggccaacgccaucugcagcgccguccccucccacugggugcccaccagccggaccacgugguccauccacgcgaagcacgaguggaugaccaccgaggacaugcucgccguguggaaccgcgucuggauccaggagaacccguggauggaggacaagacccccguggagagcugggaggaggugcccuaccugggcaagcgggaggaccaguggugcgggagccugaucggccucacgucccgcgccaccugggccaagaacauccagaccgccaucaaccagguccggagccugaucgggaacgaggaguacaccgacuacaugcccuccaugaagcgcuuccgccgggaggaggaggaggcgggcgugcugugguga

SEQ ID NO: 9303 - RNA, 9876 nt, Artificial Sequence
  derived and/or modified CDS sequence (opt1) from DENV-2__KC294207__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacugcaugugcaccggcaaguucaagaucgucaaggagaucgccgagacgcagcacgggaccaucgugauccgcgugcaguacgagggcgacggcagccccugcaagauccccuucgagaucaccgaccuggagaagcggcacguccucgggcgccugaucaccgugaacccgaucgugacggagaaggacucccccgucaacaucgaggcggagccgcccuucggcgacagcuacaucaucguggggguggagccgggccagcugaagcucaacugguucaagaagggguccagcaucggccagauguucgagaccaccaugcgcggcgccaagcggauggccauccugggggacaccgccugggacuucggcucccucgggggcgucuucacgagcaucgggaaggcccuccaccagguguucggcgcgaucuacggcgccgccuucuccggggugagcuggaccaugaagauccugaucggcgucaucaucaccuggaucgggaugaacucccgcagcaccucccugagcgugucccuggugcucgucggcguggugacgcuguaccugggggccaugguccaggcggacagcggcugcaucguguccuggaagaacaaggagcucaagugcggcagcgggaucuucaucaccgacaacgugcacaccuggaccgagcaguacaaguuccagcccgagucccccagcaagcuggccagcgccauccagaaggcccacgaggagggcaucugcgggauccgguccgucacgcgccuggagaaccucauguggaagcagaucacccccgagcugaaccacauccugagcgagaacgaggugaagcucaccaucaugaccggcgacaucaaggggaucaugcaggccggcaagcggucccugcgcccgcagcccacggagcugaaguacagcuggaagaccuggggcaaggcgaagaugcucuccaccgagagccacaaccagaccuuccugaucgacgggcccgagacggccgagugcccgaacaccaaccgggccuggaacucccuggagguggaggacuacggcuucggggucuucaccaccaacaucuggcucaagcugcgcgagaagcaggacguguucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacgcuguggagcaacggcgugcuggaguccgagaugaucauccccaagaacuucgccgggcccgugagccagcacaacuaccgcccgggcuaccacacccagaccgcggggcccggccaccucgggaagcuggagauggacuucgaccugugcgagggcaccacggucguggugaccgaggacugcggcaaccgggggcccucccuccgcaccaccacggccagcggcaagcugaucaccgaguggugcugccggagcugcacccugcccccgcuccgcuaccgcggggaggacggcugcugguacgggauggagauccgcccccugaaggagaaggaggagaaccuggucaacucccucgugaccgccggccacggccagaucgacaacuucagccugggggugcugggcauggcccucuuccuggaggagaugcugcggacgcgcgucgggaccaagcacgcgauccuccugguggcccuguccuucgugacccucaucaccggcaacaugagcuuccgggaccuggggcgcgucauggugauggugggcgccacgaugaccgacgacaucggcaugggggucaccuaccuggcccuccuggccgcguucaaggugcgccccaccuucgccgccggccugcuccugcggaagcugacguccaaggagcucaugauggccaccaucgggaucgcccugcugagccaguccacccuccccgagaccauccuggagcugacggacgcgcucgcccugggcaugauggcccugaagaucgugcgcaacauggagaaguaccagcucgccgucaccaucauggccaucagcugcgugccgaacgcggugauccugcagaacgccuggaaggucuccugcaccauccuggccgccgugagcgugagcccccuccugcugaccagcucccagcagaaggcggacuggaucccccucgcccugacgaucaagggccugaaccccaccgccaucuuccucaccacccugagccggacguccaagaagcgcagcuggccgcugaacgaggccaucauggccgucgggaugguguccauccucgcgagcucccugcugaagaacgacauccccaugaccggcccccucgucgccgggggccugcugaccgugugcuacgugcucaccgggcggagcgccgaccuggagcuggagcgcgccgccgacgucaagugggaggaccaggcggagaucagcggcuccagccccauccucuccaucacgaucagcgaggacggcuccaugagcaucaagaacgaggaggaggagcagacccugaccauccugauccggaccgggcuccuggugaucuccggcguguucccggucagcauccccaucaccgccgccgccugguaccugugggaggugaagaagcagcgcgccggggugcucugggacguccccagcccgccgcccgugggcaaggcggagcuggaggacggggccuaccggaucaagcagcgcggcauccugggcuacagccagaucggggccggcguguacaaggaggggacguuccacaccauguggcacgucacccggggcgccgugcucaugcaccgcgggaagcggaucgagcccuccugggccgacgugaagaaggaccugaucagcuacggcggcggguggaagcuggagggcgaguggaaggagggggaggagguccaggugcucgcgcuggagcccggcaagaacccccgcgccgugcagaccaagcccgggaucuucaagacgaacaccggcaccaucggcgccgucucccuggacuucagccccgggaccuccggcagccccaucguggaccggaaggggaagguggucggccucuacggcaacgggguggugacgcgcuccggcgccuacgucagcgcgaucgcccagaccgagaaguccaucgaggacaaccccgagaucgaggacgacaucuuccggaagaagcgccugaccaucauggaccugcaccccggggccggcaagaccaagcgguaccugcccgccaucgugcgcgaggccaucaagcgggggcuccgcacgcugauccuggcgccgacccgcguggucgccgccgagauggaggaggcccuccggggccugcccauccgcuaccagacccccgccauccgggcggagcacaccggccgcgagaucguggaccugaugugccacgccacguucaccaugcggcuccugagccccgugcgcgucccgaacuacaaccugaucaucauggacgaggcccacuucaccgaccccgccagcaucgccgcgcggggguacaucuccacccgcguggagaugggcgaggccgccgggaucuucaugacggccacgccgcccggcagccgggacccguucccccaguccaacgcgcccaucauggacgaggagcgcgagauccccgagcggagcuggaacuccgggcacgagugggugaccgacuucaagggcaagaccgucugguucgugccgagcaucaaggccggcaacgacaucgccgccugccuccgcaagaacgggaagaaggugauccagcugucccggaagacguucgacagcgaguacgucaagacccgcgccaacgacugggacuucguggugaccaccgacaucuccgagaugggcgcgaacuucaaggccgagcgggucaucgacccccgccggugcaugaagcccgugauccugacggacggggaggagcgcgugauccucgccggccccaugccggucacccacagcuccgccgcccagcggcgcgggcgcaucggccggaaccccaagaacgagaacgaccaguacaucuacaugggcgagccccuggagaacgacgaggacugcgcgcacuggaaggaggccaagaugcugcucgacaacaucaacacccccgaggggaucaucccgagcauguucgagcccgagcgcgagaagguggacgccaucgacggcgaguaccggcugcgcggggaggcccggaagaccuucguggaccugaugcgccggggcgaccuccccgucuggcuggccuacaagguggcggccgaggggaucaacuacgccgaccgcaaguggugcuucgacggcaucaagaacaaccagauccuggaggagaacguggaggucgagaucuggacgaaggagggcgagcggaagaagcucaagccgcgcuggcuggacgcccggaucuacuccgacccccuggcgcucaaggaguucaaggaguucgccgccgggcgcaagagccugacccugaaccucaucaccgagaugggccggcugcccaccuucaugacgcagaaggcccgcaacgcccuggacaaccucgcggugcugcacaccgccgaggucgggggcaaggccuacacccacgcccuguccgagcuccccgagacccuggagacgcugcuccugcugacccuccuggccgcggucaccggcgggaucuuccuguuccucaugagcggcaagggggugggcaagaugacccuggggaugugcugcaucaucaccgccuccauccugcucugguacgcccagauccagccgcacuggaucgccgccagcaucauccuggaguucuuccugaucguccuccugauccccgagcccgagaagcagcggacgccccaggacaaccagcugaccuacguggugaucgcgauccucaccgucguggccgccaccauggccaacgagaugggcuuccuggagaagacgaagaaggaccugggcuucggguccaucaccacccaggagagcgagagcaacauccucgacaucgaccugcgcccggccuccgcguggacccuguacgccguggccacgaccuucgucacccccaugcuccggcacagcaucgagaacuccagcgugaacgugucccugaccgccaucgcgaaccaggccacgguccugaugggccucgggaagggcuggccccugagcaagauggacaucggggugccccugcucgccaucggcugcuacucccaggugaacccgaucacccugaccgccgcccugcuccugcuggucgcgcacuacgccaucaucggccccgggcuccaggccaaggccacccgcgaggcccagaagcgggcggccgccggcaucaugaagaaccccacgguggacgggaucaccgugaucgaccuggagcccaucccguacgaccccaaguucgagaagcagcugggccaggucaugcuccugauccugugcgugacccaggugcucaugaugcgcaccacgugggcccugugcgaggcccugacccucgcgaccgggcccaucagcacccugugggagggcaaccccggccgguucuggaacacgaccaucgccgucuccauggccaacaucuuccgcgggagcuaccuggccggcgcggggcuccuguucuccaucaugaagaacaccaccaacacgcgccggggcaccggcaacgugggggagacccugggcgagaaguggaagucccgccucaacgcccuggggaaguccgaguuccagaucuacaagaaguccggcauccaggagguggaccggacccuggccaaggaggggaucaagcgcggcgagacggaccaccacgccgucucccggggcagcgccaagcuccgcugguucguggagcggaacauggugaccccggaggggaaggucguggaccugggcugcgggcgcggcgggugguccuacuacugcggcggccugaagaacgugcgggaggucaaggggcucaccaagggcgggcccggccacgaggagcccauccccaugagcaccuacggguggaaccuggugcgccugcaguccggcguggacgucuucuucacgccgcccgagaagugcgacacccuccugugcgacaucggcgagagcagccccaaccccaccaucgaggcggggcggacccugcgcgugcucaaccugguggagaacuggcugaacaacaacacccaguucugcaucaagguccucaacccguacaugcccuccgugaucgagaagauggagacgcugcagcggaaguacggcggggcccuggugcgcaacccccugagccggaacuccacccacgagauguacugggucagcaacgccaccggcaacaucguguccagcgugaacaugaucucccgcaugcucaucaaccgguucaccaugaagcacaagaaggccacguacgagccggacgucgaccuggggagcggcacccgcaacaucggcaucgaguccgagauccccaaccuggacaucguggggaagcggaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccuccugaccaagcccugggacguggucccgauggugacccagauggccaugacggacaccacccccuucggccagcagcgcguguucaaggagaaggucgacacccggacgcaggagcccaaggaggggaccaagaagcugaugaagaucaccgccgaguggcucuggaaggagcugggcaaggagaagacgccccgcaugugcacgcgggaggaguucacccgcaaggugcgguccaacgccgcccugggggcgguguucaccgacgagaacaaguggaaguccgcccgcgaggccgucgaggacggccgguucugggagcucguggaccgcgagcggaaccugcaccuggaggggaagugcgagaccugcgucuacaacaugaugggcaagcgcgagaagaagcucggcgaguucgggaaggccaagggcucccgggcgaucugguacauguggcugggggcccgcuuccuggaguucgaggcccucggcuuccugaacgaggaccacugguucagccgggggaacucccugagcggcguggagggcgaggggcuccaccgccugggcuacauccugcgggagguggggaagaaggagggcggggccauguacgccgacgacacggcgggcugggacacccgcaucacccucgaggaccugaagaacgaggagauggucaccaaccacaugaagggcgagcacaagaagcuggccgaggccaucuucaagcucacguaccagaacaagguggugcggguccagcgcccgacgccccgggggaccgugauggacaucaucagccgcaaggaccagcggggcuccggccagguggggaccuacggccugaacacguucaccaacauggaggcccagcugauccgccagauggagggggagggcaucuucaagagcauccagcaccucaccgccaccgaggagaucgcgguccagaacuggcuggcccgcguggggcgggagcgccugucccggauggccaucagcggcgacgacugcguggucaagcccaucgacgaccgcuucgccuccgcccucacggcgcugaacgacauggggaaggugcggaaggacauccagcagugggagcccagccgcggcuggaacgacuggacccaggugccguucugcucccaccacuuccacgagcuggucaugaaggacggccgggugcucgugguccccugccgcaaccaggacgagcugaucgggcgggcccgcaucagccagggcgccggguggucccugaaggagaccgccugccucggcaagagcuacgcccagauguggacccugauguacuuccaccggcgcgaccugcggcucgcggccaacgccaucugcuccgccgugcccagccacugggugcccaccucccgcacgaccuggagcauccacgcgaagcacgaguggaugaccaccgaggacaugcuggucguguggaaccggguguggauccaggagaacccguggauggaggacaagacgcccgucgaguccugggaggaggugcccuaccuggggaagcgcgaggaccaguggugcggcagccucaucggccugaccucccgggccaccugggccaagaacauccagaccgccaucaaccaggugcgcagccugaucgggaacgagggcuacacggacuacaugcccagcaugaagcgguuccgccgcgaggaggaggaggccgggguccucugguga

SEQ ID NO: 9304 - RNA, 9876 nt, Artificial Sequence
  derived and/or modified CDS sequence (opt1) from DENV-2__KC294208__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggagggggaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucgucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaagguccggagcaacgccgcccugggcgcgguguucaccgacgagaacaaguggaaguccgcccgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggucgugcgggugcagcgcccgacgccccggggcaccgucauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgcggugcagaacuggcucgcccgcgucggccgggagcgccugagccggauggccaucuccggggacgacugcguggugaagcccaucgacgaccgcuucgccagcgcccugacggcgcucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccguccccucccacugggugcccaccagccgcacgaccugguccauccacgcgaagcacgaguggaugaccaccgaggacaugcucguggucuggaaccggguguggauccaggagaacccguggauggaggacaagacgcccguggagagcugggaggagguccccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggccggcgugcugugguga

SEQ ID NO: 9305 - RNA, 9876 nt, Artificial Sequence
  derived and/or modified CDS sequence (opt1) from DENV-2__KC294209__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcguggggaagaugacccucggcaugugcugcaucaucaccgccagcauccugcugugguacgcccagauccagccgcacuggaucgccgccuccaucauccucgaguucuuccugaucguccugcucauccccgagcccgagaagcagcggacgccccaggacaaccagcugaccuacguggugaucgcgauccugaccgucguggccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgucacccccaugcugcggcacuccaucgagaacagcuccgugaacgugagccucaccgccaucgcgaaccaggccacgguccugauggggcugggcaagggguggccccucuccaagauggacaucggcgugccccugcuggccaucgggugcuacagccaggugaacccgaucacccucaccgccgcccugcugcuccuggucgcgcacuacgccaucaucggccccggccugcaggccaaggccacccgcgaggcccagaagcgggcggccgccgggaucaugaagaaccccacgguggacggcaucaccgugaucgaccucgagcccaucccguacgaccccaaguucgagaagcagcuggggcaggucaugcugcucauccugugcgugacccaggugcugaugaugcgcaccacgugggcccucugcgaggcccugacccuggcgaccggccccaucuccacccucugggaggggaaccccggccgguucuggaacacgaccaucgccgucagcauggccaacaucuuccgcggcuccuaccuggccggggcgggccuccuguucagcaucaugaagaacaccaccaacacgcgccgggggaccggcaacgugggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgucagccggggcuccgccaagcugcgcugguucguggagcggaacauggugaccccggagggcaaggucguggaccucgggugcggccgcgggggcuggagcuacuacugcgggggccugaagaacgugcgggaggucaagggccugaccaagggcggccccgggcacgaggagcccauccccauguccaccuacggcuggaaccucgugcgccugcagagcgggguggacgucuucuucacgccgcccgagaagugcgacacccugcucugcgacaucggcgagagcucccccaaccccaccaucgaggcgggccggacccugcgcgugcugaaccucguggagaacuggcugaacaacaacacccaguucugcaucaagguccugaacccguacaugcccagcgugaucgagaagauggagacgcuccagcggaaguacgggggcgcccuggugcgcaacccccugucccggaacagcacccacgagauguacugggucuccaacgccaccgggaacaucgugagcuccgugaacaugaucagccgcaugcugaucaaccgguucaccaugaagcacaagaaggccacguacgagccggacgucgaccucggcuccgggacccgcaacaucggcaucgagagcgagauccccaaccuggacaucgugggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggucgugcgccugcucaccaagcccugggacguggucccgauggugacccagauggccaugacggacaccacccccuucggccagcagcgcguguucaaggagaaggucgacacccggacgcaggagcccaaggagggcaccaagaagcugaugaagaucaccgccgaguggcuguggaaggagcucgggaaggagaagacgccccggaugugcacgcgggaggaguucacccgcaaggugcggagcaacgccgcccugggcgcgguguucaccgacgagaacaaguggaaguccgcccgcgaggccgucgaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcgggguggagggcgagggccugcaccgccucggguacauccugcgggaggugggcaagaaggagggcggcgccauguacgccgacgacacggcggggugggacacccgcaucacccuggaggaccucaagaacgaggagauggucaccaaccacaugaagggcgagcacaagaagcuggccgaggccaucuucaagcugacguaccagaacaagguggugcggguccagcgcccgacgccccggggcaccgugauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgcgguccagaacuggcucgcccgcgugggccgggagcgccugagccggauggccaucuccggggacgacugcguggucaagcccaucgacgaccgcuucgccagcgcccugacggcgcucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccgugcccucccacugggugcccaccagccgcacgaccugguccauccacgcgaagcacgaguggaugaccaccgaggacaugcucgucguguggaaccggguguggauccaggagaacccguggauggaggacaagacgcccgucgagagcugggaggaggugcccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggccggcguccugugguga

SEQ ID NO: 9306 - RNA, 9876 nt, Artificial Sequence
  derived and/or modified CDS sequence (opt1) from DENV-2__KC294214__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggcggaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccgcagcgucacgcggcuggagaaccucauguggaagcagaucacccccgagcugaaccacauccuguccgagaacgaggugaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccggccgggcuaccacacccagaccgcggggcccuggcaccucggcaagcuggagauggacuucgacuucugcgaggggaccacggucguggugaccgaggacugcggcaaccgcggccccagccugcggaccaccacggccagcgggaagcucaucaccgaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacgcgggucggcaccaagcacgcgauccugcucguggcccugagcuucgugacccugaucaccgggaacauguccuuccgcgaccucggccgcgucauggugauggugggggccacgaugaccgacgacaucggcaugggcgucaccuaccuggcccugcucgccgcguucaaggugcggcccaccuucgccgccgggcugcugcuccgcaagcugacgagcaaggagcugaugauggccaccaucggcaucgcccuccugucccagagcacccugcccgagaccauccucgagcugacggacgcgcuggcccucgggaugauggcccugaagaucgugcggaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccgcacgagcaagaagcgguccuggccgcugaacgaggccaucauggccgucggcauggugagcauccuggcguccagccuccugaagaacgacauccccaugaccgggccccuggucgccggcgggcuccugaccgugugcuacgugcugaccggccgcagcgccgaccucgagcuggagcgggccgccgacgucaagugggaggaccaggcggagaucuccgggagcucccccauccugagcaucacgaucuccgaggacggcagcauguccaucaagaacgaggaggaggagcagacccucaccauccugauccgcaccggccugcucgugaucagcgggguguucccggucuccauccccaucaccgccgccgccugguaccugugggaggugaagaagcagcgggccggcgugcugugggacguccccagcccgccgcccguggggaaggcggagcucgaggacggcgccuaccgcaucaagcagcgggggauccugggcuacucccagaucggcgccgggguguacaaggagggcacguuccacaccauguggcacgucacccgcggggccgugcugaugcaccggggcaagcgcaucgagcccagcugggccgacgugaagaaggaccucaucuccuacgggggcggcuggaagcuggagggggaguggaaggagggcgaggagguccaggugcuggcgcucgagcccgggaagaacccccgggccgugcagaccaagcccggcaucuucaagacgaacaccgggaccaucggcgccgucagccuggacuucucccccggcaccagcgggucccccaucguggaccgcaagggcaagguggucgggcuguacggcaacggcguggugacgcggagcggggccuacgucuccgcgaucgcccagaccgagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcgcacgcucauccuggcgccgacccggguggucgccgccgagauggaggaggcccugcgcgggcuccccauccgguaccagacccccgccauccgcgcggagcacaccggccgggagaucguggaccugaugugccacgccacguucaccaugcgccugcucagccccgugcgggucccgaacuacaaccugaucaucauggacgaggcccacuucaccgaccccgccuccaucgccgcgcgcggcuacaucagcacccggguggagaugggggaggccgccggcaucuucaugacggccacgccgcccgggucccgcgacccguucccccagagcaacgcgcccaucauggacgaggagcgggagauccccgagcgcuccuggaacagcggccacgagugggugaccgacuucaaggggaagaccgucugguucgugccguccaucaaggccggcaacgacaucgccgccugccugcggaagaacggcaagaaggugauccagcucagccgcaagacguucgacuccgaguacgucaagacccgggccaacgacugggacuucguggugaccaccgacaucagcgagaugggggcgaacuucaaggccgagcgcgucaucgacccccggcgcugcaugaagcccgugauccugacggacggcgaggagcgggugauccuggccgggcccaugccggucacccacuccagcgccgcccagcgccgcggccggaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgggagaagguggacgccaucgacggggaguaccgccuccggggcgaggcccgcaagaccuucguggaccugaugcggcgcggggaccugcccgucuggcucgccuacaagguggcggccgagggcaucaacuacgccgaccggaaguggugcuucgacgggaucaagaacaaccagauccuggaggagaacguggaggucgagaucuggacgaaggagggcgagcgcaagaagcugaagccgcgguggcucgacgcccgcaucuacagcgacccccuggcgcugaaggaguucaaggaguucgccgccggccggaagucccucacccugaaccugaucaccgagauggggcgccuccccaccuucaugacgcagaaggcccggaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcgcacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccggccggccagcgcguggacccuguacgccguggccacgaccuucgugacccccaugcugcgccacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgggaggcccagaagcgcgcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcggaccacgugggcccucugcgaggcccugacccuggcgaccggccccaucuccacccucugggaggggaaccccggccgcuucuggaacacgaccaucgccgugagcauggccaacaucuuccgcggcuccuaccuggccggggcgggccuccuguucagcaucaugaagaacaccaccaacacgcggcgcgggaccggcaacgucggcgagacccugggggagaaguggaagucccggcugaacgcccucggcaagagcgaguuccagaucuacaagaaguccgggauccaggagguggaccgcacccuggccaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggcgggccgcacccugcggguccugaaccucguggagaacuggcugaacaacaacacccaguucugcaucaaggugcugaacccguacaugcccagcgucaucgagaagauggagacgcuccagcgcaaguacgggggcgcccuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccucggcuccgggacccggaacaucggcaucgagagcgagauccccaaccuggacaucgucggcaagcgcaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagcccugggacguggugccgauggucacccagauggccaugacggacaccacccccuucggccagcagcggguguucaaggagaagguggacacccgcacgcaggagcccaaggagggcaccaagaagcugaugaagaucaccgccgaguggcuguggaaggagcucgggaaggagaagacgccccggaugugcacgcgcgaggaguucacccggaagguccgcagcaacgccgcccugggcgcgguguucaccgacgagaacaaguggaaguccgcccgggaggccguggaggacgggcgcuucugggagcuggucgaccgggagcgcaaccuccaccuggagggcaagugcgagaccugcguguacaacaugauggggaagcgggagaagaagcugggcgaguucggcaaggccaaggggagccgcgcgaucugguacauguggcucggcgcccgguuccuggaguucgaggcccugggguuccucaacgaggaccacugguucucccgcggcaacagccugagcggggucgagggcgagggccugcaccggcucggguacauccugcgcgaggugggcaagaaggagggcggcgccauguacgccgacgacacggcggggugggacacccggaucacccuggaggaccucaagaacgaggagauggugaccaaccacaugaagggcgagcacaagaagcuggccgaggccaucuucaagcugacguaccagaacaaggucgugcgcgugcagcggccgacgccccgcggcaccgucauggacaucaucucccggaaggaccagcgcgggagcggccagguggggaccuacggccucaacacguucaccaacauggaggcccagcugauccgccagauggagggcgaggggaucuucaaguccauccagcaccugaccaccacggaggagaucgccgugcagaacuggcucgcgcgggucggccgcgagcggcugagccgcauggccaucuccggggacgacugcguggugaagcccaucgacgaccgguucgccagcgcccugaccgcccucaacgacaugggcaagguccgcaaggacauccagcagugggagcccucccggggguggaacgacuggacccaggugccguucugcagccaccacuuccacgagcuggugaugaaggacggccgcguccugguggugcccugccggaaccaggacgagcucaucggccgcgcgcggaucucccagggggccggcuggagccugaaggagaccgccugccuggggaaguccuacgcccagauguggacccucauguacuuccaccgccgggaccugcgccuggccgcgaacgccaucugcagcgccguccccucccacugggugcccacgagccggaccaccugguccauccacgccaagcacgaguggaugaccacggaggacaugcucguggucuggaaccgcguguggauccaggagaacccguggauggaggacaagacccccguggagagcugggaggagguccccuaccugggcaagcgggaggaccaguggugcgggucccugaucggccucaccagccgcgcgaccugggccaagaacauccagacggccaucaaccaggugcggagccugaucggcaacgagggguacaccgacuacaugcccuccaugaagcgcuuccgccgggaggaggaggaggccggcgugcugugguga

SEQ ID NO: 9307 - RNA, 9876 nt, Artificial Sequence
  derived and/or modified CDS sequence (opt1) from DENV-2__KC294205__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccaccagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaccaacacgcaguucugcaucaaggugcugaacccguacaugcccagcgucaucgagaagauggagacccuccagcggaaguacgggggcgcccuggugcgcaacccccugucccggaacagcacccacgagauguacuggguguccaacgccaccgggaacaucgucagcuccgugaacaugaucagccgcaugcugaucaaccgguucacgaugaagcacaagaaggccaccuacgagccggacguggaccucggcuccgggacccgcaacaucggcaucgagagcgagauccccaaccuggacaucgucggcaagcggaucgagaagaucaagcaggagcacgagaccuccuggcacuacgaccaggaccaccccuacaagacgugggccuaccacgggagcuacgagaccaagcagaccggcuccgcgagcuccauggugaacggggugguccgccugcucaccaagcccugggacguggugccgauggucacgcagauggccaugaccgacaccacccccuucggccagcagcgcguguucaaggagaagguggacacgcggacccaggagcccaaggagggcaccaagaagcugaugaagaucaccgccgaguggcuguggaaggagcucgggaaggagaagacgccccgcaugugcacccgggaggaguucacccgcaagguccggagcaacgccgcccugggcgcgguguucaccgacgagaacaaguggaaguccgcccgcgaggccguggaggacgggcgguucugggagcuggucgaccgcgagcggaaccuccaccuggagggcaagugcgagacgugcguguacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacaccgcggggugggacacccgcaucacccuggaggaccucaagaacgaggagauggugacgaaccacaugaagggcgagcacaagaagcuggccgaggccaucuucaagcugaccuaccagaacaaggucgugcgggugcagcgcccgacgccccggggcaccgucauggacaucaucucccgcaaggaccagcgggggagcggccagguggggacguacggccucaacaccuucaccaacauggaggcccagcugauccgccagauggagggcgaggggaucuucaaguccauccagcaccugaccgccacggaggagaucgcggugcagaacuggcucgcccgcgucggccgggagcgccugagccggauggccaucuccggggacgacugcguggugaagcccaucgacgaccgcuucgccagcgcccugaccgcgcucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccguccccucccacugggugcccacgagccgcaccaccugguccauccacgcgaagcacgaguggaugaccacggaggacaugcucguggucuggaaccggguguggauccaggagaacccguggauggaggacaagacccccguggagagcugggaggagguccccuaccugggcaagcgcgaggaccaguggugcgggucccugaucggccucaccagccgggccaccugggccaagaacauccagacggccaucaaccaggugcgcagccugaucggcaacgagggguacaccgacuacaugcccuccaugaagcgguuccgccgcgaggaggaggaggccggcgugcugugguga

SEQ ID NO: 9308 - RNA, 9876 nt, Artificial Sequence
  derived and/or modified CDS sequence (opt1) from DENV-2__KC294210__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaugauggaguccagcccccgcaccggccucgacuucaacgagauggugcugcugcagauggaggacaaggccuggcucguccaccggcagugguuccuggaccugccccuccccuggcugccgggggccgacacccagggcuccaacuggauccagaaggagacgcuggugaccuucaagaacccccacgcgaagaagcaggacguggucgugcucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucaccgaccuggagaagcggcacguccucgggcgccugaucaccgugaacccgaucgugaccgagaaggacucccccgucaacaucgaggcggagccgcccuucggcgacagcuacaucaucguggggguggagccgggccagcugaagcucaacugguucaagaagggguccagcaucggccagauguucgagacgaccaugcgcggcgccaagcggauggccauccugggggacaccgccugggacuucggcucccucggcggggucuucaccagcaucgggaaggcccuccaccagguguucggggcgaucuacggcgccgccuucuccggggugagcuggacgaugaagauccugaucggcgucaucaucaccuggaucgggaugaacucccgcagcaccucccugagcgugucccuggugcucgucggcguggugacccuguaccugggggccaugguccaggcggacagcggcugcaucguguccuggaagaacaaggagcucaagugcggcagcgggaucuucaucacggacaacgugcacaccuggaccgagcaguacaaguuccagcccgagagccccuccaagcuggccagcgccauccagaaggcccacgaggagggcaucugcgggauccgguccgucacccgccuggagaaccucauguggaagcagaucacgcccgagcugaaccacauccugagcgagaacgaggugaagcucaccaucaugaccggcgacaucaaggggaucaugcaggccggcaagcggucccugcgcccgcagcccaccgagcugaaguacagcuggaagacguggggcaaggcgaagaugcucuccaccgagagccacaaccagaccuuccugaucgacgggcccgagaccgccgagugcccgaacacgaaccgggccuggaacucccuggagguggaggacuacggcuucggggucuucaccaccaacaucuggcucaagcugcgcgagaagcaggacguguucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccuccgggaagcucaucacggaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacccgcgucggcacgaagcacgcgauccugcucguggcccuguccuucgugacccugaucaccgggaacaugagcuuccgggaccucggccgcgucauggugauggugggggccaccaugacggacgacaucggcaugggcgucaccuaccuggcccugcucgccgcguucaaggugcgccccaccuucgccgccgggcugcugcuccggaagcugaccuccaaggagcugaugauggccacgaucggcaucgcccuccugagccaguccacccugcccgagaccauccucgagcugaccgacgcgcuggcccucgggaugauggcccugaagaucgugcgcaacauggagaaguaccagcuggccgucacgaucauggccaucagcugcgugccgaacgcggugauccuccagaacgccuggaaggucuccugcaccauccuggccgccgugagcgugagcccccugcuccugaccagcucccagcagaaggcggacuggaucccccuggcccucaccaucaagggccugaaccccacggccaucuuccugaccacccucagccggaccuccaagaagcgcagcuggccgcugaacgaggccaucauggccgucggcaugguguccauccuggcgagcagccuccugaagaacgacauccccaugacggggccccuggucgccggcgggcuccugaccgugugcuacgugcugaccggccgguccgccgaccucgagcuggagcgcgccgccgacgucaagugggaggaccaggcggagaucagcggguccagccccauccuguccaucaccaucagcgaggacggcuccaugagcaucaagaacgaggaggaggagcagacgcucaccauccugauccggaccggccugcucgugaucuccgggguguucccggucagcauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacagccagaucggcgccgggguguacaaggagggcaccuuccacacgauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcgcucgagcccgggaagaacccccgcgccgugcagaccaagcccggcaucuucaagaccaacacggggaccaucggcgccgucucccuggacuucagccccggcaccuccgggagccccaucguggaccggaagggcaagguggucgggcuguacggcaacggcguggugacccgcuccggggccuacgucagcgcgaucgcccagacggagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacccucauccuggcgccgacgcgcguggucgccgccgagauggaggaggcccugcgggggcuccccauccgcuaccagacccccgccauccgggcggagcacaccggccgcgagaucguggaccugaugugccacgccaccuucacgaugcggcugcucucccccgugcgcgucccgaacuacaaccugaucaucauggacgaggcccacuucaccgaccccgccagcaucgccgcgcggggcuacaucuccacccgcguggagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagaccgucugguucgugccgagcaucaaggccggcaacgacaucgccgccugccugcgcaagaacggcaagaaggugauccagcucucccggaagaccuucgacagcgaguacgucaagacgcgcgccaacgacugggacuucguggugaccaccgacaucuccgagaugggggcgaacuucaaggccgagcgggucaucgacccccgccggugcaugaagcccgugauccugaccgacggcgaggagcgcgugauccuggccgggcccaugccggucacgcacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacuccgacccccuggcgcugaaggaguucaaggaguucgccgccggccgcaagagccucacgcugaaccugaucaccgagauggggcggcuccccaccuucaugacccagaaggcccgcaacgcccuggacaaccuggcggugcuccacacggccgaggugggcgggaaggccuacacccacgcccuguccgagcugcccgagacccucgagacccugcugcuccugacgcugcucgccgcggucaccggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugacguacgucgugaucgcgauccugaccguggucgccgccaccauggccaacgagaugggguuccucgagaagaccaagaaggaccugggcuucggcagcaucacgacccaggaguccgagagcaacauccuggacaucgaccuccgcccggccuccgcguggacccuguacgccguggccaccacguucgugacccccaugcugcggcacagcaucgagaacuccagcgucaacgugucccucaccgccaucgcgaaccaggccaccgugcugauggggcugggcaagggguggccccucagcaagauggacaucggcgucccccugcuggccaucgggugcuacucccaggugaacccgaucacgcucaccgccgcccugcugcuccugguggcgcacuacgccaucaucggccccggccugcaggccaaggccacccgcgaggcccagaagcgggcggccgccgggaucaugaagaaccccaccgucgacggcaucacggugaucgaccucgagcccaucccguacgaccccaaguucgagaagcagcuggggcaggucaugcugcucauccugugcgucacccaggugcugaugaugcgcaccaccugggcccucugcgaggcccugacgcuggcgaccggccccaucagcacccucugggaggggaaccccggccgguucuggaacaccacgaucgccguguccauggccaacaucuuccgcggcagcuaccuggccggggcgggccuccuguucuccaucaugaagaacaccaccaacacccgccgggggacgggcaacgucggcgagacccugggggagaaguggaagucccgccugaacgcccucggcaaguccgaguuccagaucuacaagaaguccgggauccaggagguggaccggacccuggccaaggagggcaucaagcgcggggagaccgaccaccacgccgugucccggggcagcgccaagcugcgcugguucgucgagcggaacauggugacgccggagggcaagguggucgaccucgggugcggccgcgggggcugguccuacuacugcgggggccugaagaacgugcgggaggugaagggccugaccaagggcgggcccgggcacgaggagcccauccccaugagcaccuacggcuggaaccucguccgccugcagagcgggguggacguguucuucaccccgcccgagaagugcgacacgcugcucugcgacaucggcgaguccagccccaaccccaccaucgaggcgggccggacccugcgcguccugaaccucguggagaacuggcugaacaacaacacccaguucugcaucaaggugcugaacccguacaugcccuccgucaucgagaagauggagacccuccagcggaaguacgggggcgcccuggugcgcaacccccugagccggaacuccacgcacgagauguacugggugagcaacgccaccgggaacaucgucuccagcgugaacaugaucucccgcaugcugaucaaccgguucaccaugaagcacaagaaggccaccuacgagccggacguggaccucggcagcgggacgcgcaacaucggcaucgaguccgagauccccaaccuggacaucgucggcaagcggaucgagaagaucaagcaggagcacgagaccagcuggcacuacgaccaggaccaccccuacaagaccugggccuaccacggguccuacgagaccaagcagacgggcagcgcguccagcauggugaacggggugguccgccugcucaccaagcccugggacguggugccgauggucacccagauggccaugaccgacacgacccccuucggccagcagcgcguguucaaggagaagguggacacccggacccaggagcccaaggagggcacgaagaagcugaugaagaucaccgccgaguggcuguggaaggagcucgggaaggagaagacgccccggaugugcacccgggaggaguucacgcgcaagguccgguccaacgccgcccugggcgcgguguucaccgacgagaacaaguggaaguccgcccgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggucccgggcgaucugguacauguggcucggcgcccgcuuccuggaguucgaggcccugggguuccucaacgaggaccacugguucagccggggcaacagccuguccggggucgagggcgagggccugcaccgccucggguacauccugcgggaggugggcaagaaggagggcggcgccauguacgccgacgacaccgcggggugggacacgcgcaucacccuggaggaccucaagaacgaggagauggugaccaaccacaugaagggcgagcacaagaagcuggccgaggccaucuucaagcugaccuaccagaacaaggucgugcgggugcagcgcccgacgccccggggcaccgucauggacaucaucagccgcaaggaccagcggggguccggccagguggggaccuacggccucaacaccuucacgaacauggaggcccagcugauccgccagauggagggcgaggggaucuucaagagcauccagcaccugaccgccaccgaggagaucgcggugcagaacuggcucguccgcgugggccgggagcgccugucccggauggccaucagcggggacgacugcguggucaagcccaucgacgaccgcuucgccuccgcccugaccgcccucaacgacaugggcaaggugcggaaggacauccagcagugggagcccagccgcggguggaacgacuggacccaggugccguucugcucccaccacuuccacgagcuggucaugaaggacggccgggugcuggugguccccugccgcaaccaggacgagcucaucggccgggcgcgcaucagccagggggccggcuggucccugaaggagaccgccugccugggcaagagcuacgcccagauguggacccucauguacuuccaccggcgcgaccugcggcuggccgcgaacgccaucugcuccgccgugcccagccacugggugcccaccucccgcaccacguggagcauccacgccaagcacgaguggaugaccaccgaggacaugcucgucguguggaaccggguguggauccaggagaacccguggauggaggacaagacccccgucgaguccugggaggaggugcccuaccugggcaagcgcgaggaccaguggugcgggagccugaucggccucacgagccgggcgaccugggccaagaacauccagaccgccaucaaccaggugcgcucccugaucggcaacgagggguacaccgacuacaugcccagcaugaagcgguuccgccgcgaggaggaggaggccggcguccugugguga

SEQ ID NO: 9309 - RNA, 9876 nt, Artificial Sequence
  derived and/or modified CDS sequence (opt1) from DENV-2__KC294215__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucgucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccaaguggcuguggaaggagcucgggaaggagaagacgccccggaugugcacgcgggaggaguucacccgcaagguccggagcaacgccgcccugggcgcgguguucaccgacgagaacaaguggaaguccgcccgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggucgugcgggugcagcgcccgacgccccggggcaccgucauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgcggugcagaacuggcucgcccgcgucggccgggagcgccugagccggauggccaucuccggggacgacugcguggugaagcccaucgacgaccgcuucgccagcgcccugacggcgcucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccguccccucccacugggugcccaccagccgcacgaccugguccauccacgcgaagcacgaguggaugaccaccgaggacaugcucguggucuggaaccggguguggauccaggagaacccguggauggaggacaagacgcccguggagagcugggaggagguccccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggccggcgugcugugguga

SEQ ID NO: 9310 - RNA, 9876 nt, Artificial Sequence
  derived and/or modified CDS sequence (opt1) from DENV-2__KC294216__SS-prME
accgccggcgugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggaccuggagcucaucaagaccgaggccaagcagcccgccacccugcgcaaguacugcaucgaggcgaagcugaccaacacgaccaccgagucccggugcccgacccagggcgagcccagccucaacgaggagcaggacaagcgcuucaucugcaagcacuccaugguggaccggggcugggggaacggcugcgggcuguucggcaagggcgggaucgugacgugcgccauguucacgugcaagaagaacauggagggcaaggucgugcugcccgagaaccucgaguacaccaucgugaucacgccccacagcggggaggagcacgccgucggcaacgacacggggaagcacggcgaggagaucaagaucaccccgcaguccagcaucaccgaggccgagcugaccggguacggcaccgugacgauggagugcagcccccgcaccggccuggacuucaacgagauggugcuccugcagauggaggagaaggccuggcugguccaccggcagugguuccucgaccugccccugcccuggcucccgggggcggacacccagggcagcaacuggauccagaaggagacccuggugacguucaagaacccccacgccaagaagcaggacguggucgugcuggggucccaggagggcgccaugcacaccgcccucaccggggccaccgagauccagaugagcagcggcaaccugcuguucacgggccaccucaagugccgccugcggauggacaagcugcagcucaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccuggagaagcggcacguccuggggcgccucaucacggugaacccgaucgugaccgagaaggacagccccgucaacaucgaggccgagccgcccuucggcgacuccuacaucaucaucgggguggagccgggccagcugaagcugaacugguucaagaaggggagcuccaucggccagauguucgagaccaccaugcgcggcgccaagcggauggccauccucggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccucuccgucagccuggugcuggugggcgucgugacccucuaccugggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugaccaucaugacgggcgacaucaaggggaucaugcaggcgggcaagcggagccuccgcccgcagcccaccgagcugaaguacuccuggaagaccuggggcaaggccaagaugcugagcaccgagucccacaaccagacguuccucaucgacgggcccgagaccgccgagugcccgaacaccaaccgggccuggaacagccuggagguggaggacuacggcuucggggucuucaccacgaacaucuggcugaagcuccgcgagaagcaggacguguucugcgacuccaagcugaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgcggggcccgugucccagcacaacuaccgcccgggcuaccacacccagaccgccgggcccuggcaccugggcaagcucgagauggacuucgacuucugcgaggggacgaccgucguggugaccgaggacugcggcaaccggggccccagccugcgcaccacgaccgccagcgggaagcugaucaccgaguggugcugccgguccugcacccugccgccccugcgcuaccggggcgaggacgggugcugguacggcauggagauccgcccccugaaggagaaggaggagaaccucgucaacagccuggugacggccgggcacggccagaucgacaacuucucccugggcgugcucgggauggcgcuguuccuggaggagaugcuccggacccgcgucggcaccaagcacgccauccugcugguggccgugagcuuccucacccugaucacggggaacauguccuuccgggaccugggccgcgucauggugauggugggggucgccaugaccgacgacaucggcaugggcgugaccuaccucgcccugcuggcggccuucaaggugcgccccaccuucgccgccgggcuccugcugcggaagcucacgagcaaggagcugaugauggccaccaucggcaucacccugcucucccagagcaccacgcccgagaccauccuggagcugaccgacgcgcucgcccuggggaugaugguccugaagaucgugcgcaacauggagaaguaccagcucgccgugaccaucaugacgaucuccugcguccccaacgccaugauccugaucaacgccuggaaggugagcugcaccauccuggcgguggucuccgugagcccccuccugcugaccuccagccagcagaagaccgacuggaucccccucgcccugacgaucaagggccugaaccccaccgccaucuuccucaccacccugucccggacgagcaagaagcgcuccuggccgcugaacgaggccgucauggcggugggcauggugagcauccucgccuccagccugcugaagaacgacauccccaugaccgggccccucgucgccggcgggcugcugaccgugugcuacgugcucaccggccggagcgccgaccuggagcuggagcgcgccgcggacgucaagugggaggaccaggccgagaucuccgggagcucccccauccucagcaucacgaucuccgaggacggcagcauguccaucaagaacgaggaggaggagcagacccugaccauccugauccggaccggccuccuggugaucagcgggguguucccggucuccauccccaucaccgccgccgccugguaccugugggaggugcgcaagcagcgggcgggcgugcucugggacguccccuccccgccgcccguggagaaggccgagcuggaggacggggccuaccgcaucaagcagcggggcauccugggguacucccagaucggcgccggcguguacaaggaggggacguuccacaccauguggcacgucacccgcggcgccgugcucaugcaccgggggaagcgcaucgagcccagcugggcggacgugaagaaggaccugaucuccuacggcgggggcuggaagcuggagggcgaguggaaggagggggaggagguccaggugcucgcccuggagcccggcaagaacccccgggccgugcagaccaagcccgggcuguucaagacgaacaccggcaccaucggggccgucagccucgacuucucccccggcaccagcggcucccccaucguggaccgcaaggggaagguggucggccuguacgggaacggcguggugacgcggagcggcgccuacgucuccgcgaucgcccagaccgagaaguccaucgaggacaaccccgagaucgaggacgacaucuuccgcaagaagcggcugaccaucauggaccugcaccccggggccggcaagaccaagcgcuaccuccccgccaucgugcgggaggcgaucaagcgcgggcugcgcacgcugauccucgccccgacccggguggucgccgccgagauggaggaggcccugcgcggccugcccauccgguaccagacccccgcgauccgcgccgagcacaccgggcgggagaucguggaccucaugugccacgccacguucaccaugcgccugcugagccccgugcgggucccgaacuacaaccucaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccugcggaagaacggcaagaaggugauccagcugagccgcaagacguucgacuccgaguacgucaagacccgggcgaacgacugggacuucguggugaccaccgacaucagcgagaugggcgccaacuuccgcgccgagcgggucaucgacccccgccggugcaugaagcccgugauccucacggacggggaggagcgcgugauccuggccggccccaugccggucacccacuccagcgccgcgcagcgccgggggcgcgugggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgccaucgacggcgaguaccggcugcgcggggaggcccggaagaccuucgucgaccucaugcgccggggcgaccugcccguguggcuggcguaccgcguggccgccgaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcgcugaaggaguucaaggaguucgccgccggccgcaagucccugacccucaaccugaucaccgagaugggccggcugcccaccuucaugacgcagaaggcccgcaacgcgcucgacaaccuggccguccugcacaccgccgaggccgggggccgggccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccgcacuggaucgccgcguccaucauccuggaguucuuccucaucgugcugcugauccccgagcccgagaagcagcgcacgccccaggacaaccagcucaccuacgucgugaucgccauccugaccguggucgccgccaccauggccaacgagaugggcuuccuggagaagacgaagcgggaccucgggcugggcagcaucaccacccaggagagcgaguccaacauccuggacaucgaccuccgcccggcgagcgccuggacccuguacgccguggccacgaccuucgugacccccaugcugcgccacuccaucgagaacagcuccgucaacgugagccucaccgccaucgcgaaccaggccacggugcugaugggccuggggaagggcuggccccucuccaagauggacaucggggucccccugcuggccaucggcugcuacagccaggugaacccgaucacccucaccgccgcgcugcugcuccugguggcccacuacgccaucaucgggcccggccugcaggccaaggccacccgggaggcgcagaagcgcgccgccgccggcaucaugaagaaccccacggucgacgggaucaccgugaucgaccucgagcccaucccguacgaccccaaguucgagaagcagcugggccaggugaugcugcucauccugugcgucacccaggugcugaugaugcggaccacgugggcccucugcgaggcgcugacccuggccaccgggcccaucuccacccucugggagggcaaccccgggcgcuucuggaacacgaccaucgccgugagcauggccaacaucuuccggggcuccuaccuggccggcgcggggcuccuguucagcaucaugaagaacaccaccaacacgcgccggggcaccgggaacaucggcgagacccugggcgagaaguggaagucccgccugaacgcccucggcaagagcgaguuccagaucuacaagcgguccggcauccaggaggucgaccgcacccuggccaaggaggggaucaagcggggcgagacggaccaccacgccgugagccgcggguccgcgaagcugcggugguucguggagcgcaacauggucaccccggagggcaaggugguggaccucggcugcgggcggggcggguggagcuacuacugcggcgggcugaagaacguccgcgaggugaagggccugaccaagggcgggcccggccacgaggagcccauccccauguccaccuacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacccaguucugcaucaaggugcugaacccguacaugcccagcgugaucgagaagauggagacgcugcagcgcaaguacggcggggcccucguccgcaacccccugucccggaacagcacccacgagauguacuggguguccaacgccaccggcaacaucgugagcuccgucaacaugaucagccgcaugcugaucaaccgguucaccaugaagcacaagaaggccacguacgagccggacguggaccucggguccggcacccgcaacaucgggaucgagagcgagauccccaaccuggcgaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacguggucccgauggugacccagauggccaugacggacaccacccccuucgggcagcagcggguguucaaggagaaggucgacacccgcacgcaggagcccaaggagggcaccaagaagcugaugcggaucaccgccgaguggcuguggaaggagcucggcaagaagaagacgccccgcaugugcacgcgggaggaguucacccgcaaggugcggagcaacgcggcccugggggccaucuucaccgacgagaacaaguggaaguccgcccgcgaggccguggaggacagccgguucugggagcuggucgaccgcgagcggaaccuccaccuggagggcaagugcgagaccugcguguacaacaugauggggaagcgcgagaagaagcugggcgaguucgggaaggcgaagggcucccgggccaucugguacauguggcucggcgcccgcuuccuggaguucgaggcccugggguuccucaacgaggaccacugguucagccggggcaacagccuguccggggucgagggcgaggggcugcaccgccucggcuacauccugcgcgacgugagcaagaaggagggcggggcgauguacgccgacgacacggccggcugggacacccggaucacccuggaggaccucaagaacgaggagauggugaccaaccacaugaagggggagcacaagaagcuggccgaggccgucuucaagcugacguaccagaacaagguggugcgcguccagcggccgacgccccgcggcaccgugauggacaucaucucccggcgcgaccagcgggggagcggccaggugggcaccuacgggcucaacaccuucaccaacauggaggcgcagcugauccgccagauggagggcgaggggaucuucaaguccauccagcaccugaccgccaccgaggagaucgccguccagaacuggcucgcccgggugggccgcgagcggcugagccgcauggccaucuccggcgacgacugcguggucaagccccuggacgaccgguucgcgagcgcccucacggcccugaacgacauggggaaggugcgcaaggacauccagcagugggagcccucccggggcuggaacgacuggacccaggugccguucugcagccaccacuuccacgagcuggucaugaaggacgggcgcgugcucgugguccccugccggaaccaggacgagcugaucggccgcgcccggaucucccagggggccggcuggagccugaaggagaccgcgugccucggcaaguccuacgcccagauguggacccugauguacuuccaccgccgcgaccugcggcucgccgccaacgccaucugcagcgcggugcccucccacugggugcccaccagccgcacgaccugguccauccacgccaagcacgaguggaugaccaccgaggacaugcuggccgucuggaaccggguguggauccaggagaacccguggauggaggacaagacgcccguggagagcugggaggagguccccuaccuggggaagcgcgaggaccaguggugcggcagccucaucgggcugaccucccgggccaccugggcgaagaacauccagaccgccaucaaccaggugcgcagccugaucggcaacgaggaguacacggacuacaugcccuccaugaagcgguuccgccgggaggaggaggaggccggggugcucugguga

SEQ ID NO: 9311 - RNA, 9876 nt, Artificial Sequence
  derived and/or modified CDS sequence (opt1) from DENV-2__KC294218__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucauccugauccugcucaccgccguggcgcccagcaugaccaugcgcugcaucggcaucuccaaccgggacuucgucgagggcgugagcgggggcuccuggguggacaucguccuggagcacgggagcugcgugaccacgauggccaagaacaagcccacccuggacuucgagcucaucaagaccgaggccaagcagcccgccacccugcgcaaguacugcaucgaggccaagcugacgaacaccaccaccgagucccggugcccgacgcagggcgagcccagccucaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccucgagaagcggcacguccuggggcgccugaucaccgugaacccgaucgugacggagaaggacagccccgucaacaucgaggcggagccgcccuucggcgacuccuacaucaucguggggguggagccgggccagcucaagcugaacugguucaagaaggggagcuccaucggccagauguucgagaccaccaugcgcggcgccaagcggauggccauccugggggacaccgccugggacuucggcagccucgggggcgucuucacguccaucgggaaggcccugcaccagguguucggcgcgaucuacggcgccgccuucagcgggguguccuggaccaugaagauccugaucggcgucaucaucaccuggaucgggaugaacagccgcuccaccagccuguccgugagccucgugcuggucggcguggugacgcuguaccucggggccaugguccaggcggacuccggcugcaucgugagcuggaagaacaaggagcugaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccucgagaaccugauguggaagcagaucacccccgagcugaaccacauccucuccgagaacgaggugaagcugaccaucaugaccggcgacaucaaggggaucaugcaggccggcaagcggagccugcgcccgcagcccacggagcucaaguacuccuggaagaccuggggcaaggcgaagaugcugagcaccgagucccacaaccagaccuuccugaucgacgggcccgagacggccgagugcccgaacaccaaccgggccuggaacagccucgagguggaggacuacggcuucggggucuucaccaccaacaucuggcugaagcugcgcgagaagcaggacguguucugcgacuccaagcucaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacgcugugguccaacggcgugcucgagagcgagaugaucauccccaagaacuucgccgggcccgugucccagcacaacuaccgcccgggcuaccacacccagaccgcggggcccuggcaccugggcaagcuggagauggacuucgacuucugcgaggggaccacggucguggugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacgcgcgucggcaccaagcacgcgauccuccugguggcccugagcuucgugacccucaucaccgggaacauguccuuccgggaccugggccgcgucauggugauggugggggccacgaugaccgacgacaucggcaugggcgucaccuaccuggcccuccuggccgcguucaaggugcgccccaccuucgccgccgggcugcuccugcggaagcugacgagcaaggagcucaugauggccaccaucggcaucgcccugcugucccagagcacccuccccgagaccauccuggagcugacggacgcgcucgcccuggggaugauggcccugaagaucgugcgcaacauggagaaguaccagcucgccgucaccaucauggccaucuccugcgugccgaacgcggugauccugcagaacgccuggaaggucagcugcaccauccuggccgccguguccgugagcccccuccugcugaccuccagccagcagaaggcggacuggaucccccucgcccugacgaucaagggccugaaccccaccgccaucuuccucaccacccugucccggacgagcaagaagcgcuccuggccgcugaacgaggccaucauggccgucggcauggugagcauccucgcguccagccugcugaagaacgacauccccaugaccgggccccucgucgccggcgggcugcugaccgugugcuacgugcucaccggccggagcgccgaccuggagcuggagcgcgccgccgacgucaagugggaggaccaggcggagaucuccgggagcucccccauccucagcaucacgaucuccgaggacggcagcauguccaucaagaacgaggaggaggagcagacccugaccauccugauccggaccggccuccuggugaucagcgggguguucccggucuccauccccaucaccgccgccgccugguaccugugggaggugaagaagcagcgcgccggcgugcucugggacguccccagcccgccgcccguggggaaggcggagcuggaggacggcgccuaccggaucaagcagcgcgggauccugggcuacucccagaucggcgccgggguguacaaggagggcacguuccacaccauguggcacgucacccgcggggccgugcucaugcaccgcggcaagcggaucgagcccagcugggccgacgugaagaaggaccugaucuccuacgggggcggcuggaagcuggagggggaguggaaggagggcgaggagguccaggugcucgcgcuggagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcucuacggcaacggcguggugacgcgcagcggggccuacgucuccgcgaucgcccagaccgagaaguccaucgaggacaaccccgagaucgaggacgacaucuuccggaagaagcgccugaccaucauggaccugcaccccggcgccgggaagaccaagcgguaccugcccgccaucgugcgcgaggccaucaagcggggccuccgcacgcugauccuggcgccgacccgcguggucgccgccgagauggaggaggcccuccgggggcugcccauccgcuaccagacccccgccauccgggcggagcacaccggccgcgagaucguggaccugaugugccacgccacguucaccaugcggcuccugagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccuccgcaagaacggcaagaaggugauccagcugagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccucgccgggcccaugccggucacccacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuacaagguggcggccgagggcaucaacuacgccgaccgcaaguggugcuucgacgggaucaagaacaaccagauccuggaggagaacguggaggucgagaucuggacgaaggagggcgagcggaagaagcucaagccgcgcuggcuggacgcccggaucuacagcgacccccuggcgcucaaggaguucaaggaguucgccgccggccgcaagucccugacccugaaccucaucaccgagauggggcggcugcccaccuucaugacgcagaaggcccgcaacgcccuggacaaccucgcggugcugcacaccgccgaggugggcgggaaggccuacacccacgcccugagcgagcuccccgagacccuggagacgcugcuccugcugacccuccuggccgcggucaccggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucaccguggucgccgccaccauggccaacgagaugggguuccuggagaagacgaagaaggaccugggcuucggcagcaucaccacccaggagagcgaguccaacauccucgacaucgaccugcgcccggccagcgcguggacccuguacgccguggccacgaccuucgugacccccaugcuccggcacuccaucgagaacagcuccgucaacgugagccugaccgccaucgcgaaccaggccacggugcugauggggcucggcaagggguggccccuguccaagauggacaucggcgucccccugcucgccaucgggugcuacagccaggugaacccgaucacccugaccgccgcccugcuccugcugguggcgcacuacgccaucaucggccccggccuccaggccaaggccacccgcgaggcccagaagcgggcggccgccgggaucaugaagaaccccacggucgacggcaucaccgugaucgaccuggagcccaucccguacgaccccaaguucgagaagcagcuggggcaggucaugcuccugauccugugcgucacccaggugcucaugaugcgcaccacgugggcccugugcgaggcccugacccucgcgaccggccccaucuccacccugugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccucaacgcccugggcaagagcgaguuccagaucuacaagaaguccgggauccaggagguggaccggacccuggccaaggagggcaucaagcgcggggagacggaccaccacgccgugagccggggcuccgccaagcuccgcugguucgucgagcggaacauggugaccccggagggcaagguggucgaccuggggugcggccgcgggggcuggagcuacuacugcgggggccugaagaacgugcgggaggugaagggccucaccaagggcgggcccgggcacgaggagcccauccccauguccaccuacggcuggaaccugguccgccugcagagcgggguggacguguucuucacgccgcccgagaagugcgacacccuccugugcgacaucggcgagagcucccccaaccccaccaucgaggcgggccggacccugcgcguccucaaccugguggagaacuggcugaacaacaacacccaguucugcaucaaggugcucaacccguacaugcccagcgucaucgagaagauggagacgcugcagcggaaguacgggggcgcccuggugcgcaacccccugucccggaacagcacccacgagauguacuggguguccaacgccaccgggaacaucgucagcuccgugaacaugaucagccgcaugcucaucaaccgguucaccaugaagcacaagaaggccacguacgagccggacguggaccugggcuccgggacccgcaacaucggcaucgagagcgagauccccaaccuggacaucgucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccuccugaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcucuggaaggagcuggggaaggagaagacgccccggaugugcacgcgggaggaguucacccgcaagguccggagcaacgccgcccugggcgcgguguucaccgacgagaacaaguggaaguccgcccgcgaggccguggaggacgggcgguucugggagcucgucgaccgcgagcggaaccugcaccuggagggcaagugcgagaccugcguguacaacaugauggggaagcgcgagaagaagcucggcgaguucggcaaggccaaggggagccgggcgaucugguacauguggcugggcgcccgcuuccuggaguucgaggcccucggguuccugaacgaggaccacugguucucccggggcaacagccugagcggggucgagggcgagggccuccaccgccugggguacauccugcgggaggugggcaagaaggagggcggcgccauguacgccgacgacacggcggggugggacacccgcaucacccucgaggaccugaagaacgaggagauggugaccaaccacaugaagggcgagcacaagaagcuggccgaggccaucuucaagcucacguaccagaacaaggucgugcgggugcagcgcccgacgccccggggcaccgucauggacaucaucucccgcaaggaccagcgggggagcggccagguggggaccuacggccugaacacguucaccaacauggaggcccagcugauccgccagauggagggcgaggggaucuucaaguccauccagcaccucaccgccaccgaggagaucgcggugcagaacuggcuggcccgcgucggccgggagcgccugagccggauggccaucuccggggacgacugcguggugaagcccaucgacgaccgcuucgccagcgcccucacggcgcugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucggccgggcccgcaucucccagggggccggcuggagccugaaggagaccgccugccucgggaaguccuacgcccagauguggacccugauguacuuccaccggcgcgaccugcggcucgcggccaacgccaucugcagcgccguccccucccacugggugcccaccagccgcacgaccugguccauccacgcgaagcacgaguggaugaccaccgaggacaugcugguggucuggaaccggguguggauccaggagaacccguggauggaggacaagacgcccguggagagcugggaggagguccccuaccugggcaagcgcgaggaccaguggugcgggucccucaucggccugaccagccgggccaccugggccaagaacauccagaccgccaucaaccaggugcgcagccugaucggcaacgagggguacacggacuacaugcccuccaugaagcgguuccgccgcgaggaggaggaggccggcgugcucugguga

SEQ ID NO: 9312 - RNA, 9876 nt, Artificial Sequence
  derived and/or modified CDS sequence (opt1) from DENV-2__KC294220__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaugugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucgucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaagguccggagcaacgccgcccugggcgcgguguucaccgacgagaacaaguggaaguccgcccgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggucgugcgggugcagcgcccgacgccccggggcaccgucauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgcggugcagaacuggcucgcccgcgucggccgggagcgccugagccggauggccaucuccggggacgacugcguggugaagcccaucgacgaccgcuucgccagcgcccugacggcgcucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccguccccucccacugggugcccaccagccgcacgaccugguccauccacgcgaagcacgaguggaugaccaccgaggacaugcucguggucuggaaccggguguggauccaggagaacccguggauggaggacaagacgcccguggagagcugggaggagguccccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggccggcgugcugugguga

SEQ ID NO: 9313 - RNA, 9876 nt, Artificial Sequence
  derived and/or modified CDS sequence (opt1) from DENV-2__KC294221__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccggaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcgcggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccgccagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccggcugcgcauggacaagcuccagcugaaggggauguccuacagcaugugcaccggcaaguucaagaucgucaaggagaucgccgagacgcagcacgggaccaucgugauccgggugcaguacgagggcgacggcucccccugcaagauccccuucgagaucaccgaccuggagaagcgccacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcggggcgccaagcgcauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgguccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccgcagcgucacgcggcuggagaaccucauguggaagcagaucacccccgagcugaaccacauccuguccgagaacgaggugaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucggggucuucuccaccaacaucuggcucaagcugcgggagaagcaggacguguucugcgacagcaagcugauguccgccgccaucaaggacaaccgcgcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccuccgggaagcucaucacggaguggugcugccgcagcugcacccugcccccgcugcgguaccgcggcgaggacgggugcugguacggcauggagauccggccccucaaggagaaggaggagaaccuggucaacucccuggugaccgccgggcacggccagaucgacaacuucagccucggcgugcuggggauggcccuguuccucgaggagaugcugcgcacccgggucggcacgaagcacgcgauccugcucguggcccuguccuucgugacccugaucaccgggaacaugagcuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccuccaaggagcugaugauggccacgaucggcaucgcccuccugagccaguccacccugcccgagaccauccucgagcugaccgacgcgcuggcccucgggaugauggcccugaagaucgugcggaacauggagaaguaccagcuggccgucacgaucauggccaucagcugcgugccgaacgcggugauccuccagaacgccuggaaggucuccugcaccauccuggccgccgugagcgugagcccccugcuccugaccagcucccagcagaaggcggacuggaucccccuggcccucaccaucaagggccugaaccccacggccaucuuccugaccacccucagccgcaccuccaagaagcggagcuggccgcugaacgaggccaucauggccgucggcaugguguccauccuggcgagcagccuccugaagaacgacauccccaugacggggccccuggucgccggcgggcuccugaccgugugcuacgugcugaccggccgcuccgccgaccucgagcuggagcgggccgccgacgucaagugggaggaccaggcggagaucagcggguccagccccauccuguccaucaccaucagcgaggacggcuccaugagcaucaagaacgaggaggaggagcagacgcucaccauccugauccgcaccggccugcucgugaucuccgggguguucccggucagcauccccaucaccgccgccgccugguaccugugggaggugaagaagcagcgggccggcgugcugugggacguccccagcccgccgcccguggggaaggcggagcucgaggacggcgccuaccgcaucaagcagcgggggauccugggcuacagccagaucggcgccgggguguacaaggagggcaccuuccacacgauguggcacgucacccgcggggccgugcugaugcaccggggcaagcgcaucgagcccuccugggccgacgugaagaaggaccucaucagcuacgggggcggcuggaagcuggagggggaguggaaggagggcgaggagguccaggugcuggcgcucgagcccgggaagaacccccgggccgugcagaccaagcccggcaucuucaagaccaacacggggaccaucggcgccgucucccuggacuucagccccggcaccuccgggagccccaucguggaccgcaagggcaagguggucgggcuguacggcaacggcguggugacccgguccggggccuacgucagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcgcacccucauccuggcgccgacgcggguggucgccgccgagauggaggaggcccugcgcgggcuccccauccgguaccagacccccgccauccgcgcggagcacaccggccgggagaucguggaccugaugugccacgccaccuucacgaugcgccugcucucccccgugcgggucccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucauggacgaggagcgggagauccccgagcgcagcuggaacuccggccacgagugggugaccgacuucaaggggaagaccgucugguucgugccgagcaucaaggccggcaacgacaucgccgccugccugcggaagaacggcaagaaggugauccagcucucccgcaagaccuucgacagcgaguacgucaagacgcgggccaacgacugggacuucguggugaccaccgacaucuccgagaugggggcgaacuucaaggccgagcgcgucaucgacccccggcgcugcaugaagcccgugauccugaccgacggcgaggagcgggugauccuggccgggcccaugccggucacgcacagcuccgccgcccagcgccgcggccggaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaagguggacgccaucgacggggaguaccgccuccggggcgaggcccgcaagaccuucguggaccugaugcggcgcggggaccugcccgucuggcucgccuacaagguggcggccgagggcaucaacuacgccgaccggaaguggugcuucgacgggaucaagaacaaccagauccuggaggagaacguggaggucgagaucuggaccaaggagggcgagcgcaagaagcugaagccgcgguggcucgacgcccgcaucuacuccgacccccuggcgcugaaggaguucaaggaguucgccgccggccggaagucccucacgcugaaccugaucaccgagauggggcgccuccccaccuucaugacccagaaggcccggaacgcccuggacaaccuggcggugcuccacacggccgaggugggcgggaaggccuacacccacgcccuguccgagcugcccgagacccucgagacccugcugcuccugacgcugcucgccgcggucaccggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcgcacgccccaggacaaccagcugacguacgucgugaucgcgauccugaccguggucgccgccaccauggccaacgagaugggguuccucgagaagaccaagaaggaccugggcuucggcagcaucacgacccaggaguccgagagcaacauccuggacaucgaccuccggccggccuccgcguggacccuguacgccguggccaccacguucgugacccccaugcugcgccacagcaucgagaacuccagcgucaacgugucccucaccgccaucgcgaaccaggccaccgugcugauggggcugggcaagggguggccccucagcaagauggacaucggcgucccccugcuggccaucgggugcuacucccaggugaacccgaucacgcucaccgccgcccugcugcuccugguggcgcacuacgccaucaucggccccggccugcaggccaaggccacccgggaggcccagaagcgcgcggccgccgggaucaugaagaaccccaccgucgacggcaucacggugaucgaccucgagcccaucccguacgaccccaaguucgagaagcagcuggggcaggucaugcugcucauccugugcgucacccaggugcugaugaugcggaccaccugggcccucugcgaggcccugacgcuggcgaccggccccaucagcacccucugggaggggaaccccggccgcuucuggaacaccacgaucgccguguccauggccaacaucuuccgcggcagcuaccuggccggggcgggccuccuguucuccaucaugaagaacaccaccaacacccggcgcgggacgggcaacgucggcgagacccugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgccaagcugcggugguucgucgagcgcaacauggugacgccggagggcaagguggucgaccucgggugcggccgcggcgggugguccuacuacugcggcgggcugaagaacgugcgcgaggugaaggggcugaccaagggcggccccgggcacgaggagcccauccccaugagcaccuacggcuggaaccucguccggcugcagagcgggguggacguguucuucaccccgcccgagaagugcgacacgcugcucugcgacaucggcgaguccagccccaaccccaccaucgaggcgggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacgcacgagauguacugggugagcaacgccaccgggaacaucgucuccagcgugaacaugaucucccggaugcugaucaaccgcuucaccaugaagcacaagaaggccaccuacgagccggacguggaccucggcagcgggacgcggaacaucggcaucgaguccgagauccccaaccuggacaucgucggcaagcgcaucgagaagaucaagcaggagcacgagaccagcuggcacuacgaccaggaccaccccuacaagaccugggccuaccacggguccuacgagaccaagcagacgggcagcgcguccagcauggugaacggggugguccgccugcucaccaagcccugggacguggugccgauggucacccagauggccaugaccgacacgacccccuucggccagcagcggguguucaaggagaagguggacacccgcacccaggagcccaaggagggcacgaagaagcugaugaagaucaccgccgaguggcuguggaaggagcucgggaaggagaagacgccccggaugugcacccgcgaggaguucacgcggaagguccgcuccaacgccgcccugggcgcgguguucaccgacgagaacaaguggaaguccgcccgggaggccguggaggacgggcgcuucugggagcuggucgaccgggagcgcaaccuccaccuggagggcaagugcgagaccugcguguacaacaugauggggaagcgggagaagaagcugggcgaguucggcaaggccaaggggucccgcgcgaucugguacauguggcucggcgcccgguuccuggaguucgaggcccugggguuccucaacgaggaccacugguucagccgcggcaacagccuguccggggucgagggcgagggccugcaccggcucggguacauccugcgcgaggugggcaagaaggagggcggcgccauguacgccgacgacaccgcggggugggacacgcggaucacccuggaggaccucaagaacgaggagauggugaccaaccacaugaagggcgagcacaagaagcuggccgaggccaucuucaagcugaccuaccagaacaaggucgugcgcgugcagcggccgacgccccgcggcaccgucauggacaucaucagccggaaggaccagcgcggguccggccagguggggaccuacggccucaacaccuucacgaacauggaggcccagcugauccgccagauggagggcgaggggaucuucaagagcauccagcaccugaccgccaccgaggagaucgcggugcagaacuggcucgcccgggucggccgcgagcggcugucccgcauggccaucagcggggacgacugcguggugaagcccaucgacgaccgguucgccuccgcccugaccgcgcucaacgacaugggcaagguccgcaaggacauccagcagugggagcccagccggggguggaacgacuggacccaggugccguucugcucccaccacuuccacgagcuggugaugaaggacggccgcguccugguggugcccugccggaaccaggacgagcucaucggccgcgcccggaucagccagggggccggcuggucccugaaggagaccgccugccugggcaagagcuacgcccagauguggacccucauguacuuccaccgccgggaccugcgccuggcggccaacgccaucugcuccgccguccccagccacugggugcccaccucccggaccacguggagcauccacgcgaagcacgaguggaugaccaccgaggacaugcucguggucuggaaccgcguguggauccaggagaacccguggauggaggacaagacccccguggaguccugggaggagguccccuaccugggcaagcgggaggaccaguggugcgggagccugaucggccucacgagccgcgccaccugggccaagaacauccagaccgccaucaaccaggugcggucccugaucggcaacgagggguacaccgacuacaugcccagcaugaagcgcuuccgccgggaggaggaggaggccggcgugcugugguga

SEQ ID NO: 9314 - RNA, 9876 nt, Artificial Sequence
  derived and/or modified CDS sequence (opt1) from DENV-2__KC294223__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucgucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaagguccggagcaacgccgcccugggcgcgguguucaccgacgagaacaaguggaaguccgcccgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggucgugcgggugcagcgcccgacgccccggggcaccgucauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgcggugcagaacuggcucgcccgcgucggccgggagcgccugagccggauggccaucuccggggacgacugcguggugaagcccaucgacgaccgcuucgccagcgcccugacggcgcucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccguccccucccacugggugcccaccagccgcacgaccugguccauccacgcgaagcacgaguggaugaccaccgaggacaugcucguggucuggaaccggguguggauccaggagaacccguggauggaggacaagacgcccguggagagcugggaggagguccccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggccggcgugcugugguga

SEQ ID NO: 9315 - RNA, 9876 nt, Artificial Sequence
  derived and/or modified CDS sequence (opt1) from DENV-2__FJ906959__SS-prME
accgccggcaugaucaucaugcugauccccaccgugauggccuuccaccucaccacccggaacggggagccccacaugaucgucagccggcaggagaagggcaagucccugcuguucaagaccgaggacggggugaacaugugcacccucauggcgauggaccugggcgagcugugcgaggacaccaucaccuacaagugccccuuccucaagcagaacgagcccgaggacaucgacugcuggugcaacagcaccuccaccugggugacguacgggaccugcaccaccacgggcgagcaccgccgggagaagcgcagcgucgcccuggugccccacgugggcauggggcuggagacccggaccgagaccuggauguccagcgagggcgccuggaagcacgcccagcgcaucgagacguggauccuccggcacccgggguucaccaucauggccgcgauccuggccuacaccaucggcaccacgcacuuccagcgcgcccugaucuucauccuccugaccgccgucgcgcccuccaugaccaugcggugcaucgggaucagcaaccgcgacuucguggagggcguguccggcgggagcugggucgacaucgugcuggagcacggcuccugcgugaccacgauggccaagaacaagcccacccucgacuucgagcugaucaagaccgaggccaagcagcccgccacccugcggaaguacugcaucgaggccaagcucacgaacaccaccaccgacagccgcugcccgacgcagggggagcccucccugaacgaggagcaggacaagcgguucgucugcaagcacagcaugguggaccgcggcuggggcaacgggugcggccuguucgggaagggcgggaucgugaccugcgcgauguucacgugcaagaagaacaugaagggcaaggucgugcagcccgagaaccucgaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccggaccggccuggacuucaacgagauggugcuccugcagauggagaacaaggccuggcugguccaccgccagugguuccucgaccugccccugcccuggcucccgggcgccgacacccagggguccaacuggauccagaaggagacgcuggugaccuucaagaacccccacgcgaagaagcaggacguggucgugcugggcagccaggagggggccaugcacaccgcccucaccggcgccacggagauccagaugagcuccgggaaccugcuguucaccggccaccucaagugccggcugcgcauggacaagcugcagcucaagggcaugagcuacuccaugugcaccgggaaguucaaggucgugaaggagaucgccgagacccagcacggcacgaucgugauccggguccaguacgagggggacggcagccccugcaagauccccuucgagaucauggaccuggagaagcgccacgugcugggccggcucaucaccgugaacccgaucgucaccgagaaggacucccccgugaacaucgaggcggagccgcccuucggggacagcuacaucaucaucggcguggagccggggcagcugaagcugaacugguucaagaagggcuccagcaucgggcagaugaucgagaccacgaugcgcggcgccaagcgcauggccauccucggcgacaccgccugggacuucgggucccugggcggggucuucaccagcaucggcaaggcccugcaccagguguucggggcgaucuacggcgccgccuucuccggcgugagcuggaucaugaagauccucaucggggucaucaucaccuggaucggcaugaacucccggagcacgucccugagcgugucccuggugcuggucgggguggugacccucuaccugggcgucauggugcaggccgacagcgggugcguggucuccuggaagaacaaggagcugaagugcggcagcggcaucuucaucaccgacaacgugcacaccuggacggagcaguacaaguuccagcccgagagccccuccaagcucgcgagcgccauccagaaggcccacgaggaggggaucugcggcauccgcuccgugacccggcuggagaaccugauguggaagcagaucacccccgagcucaaccacauccugagcgagaacgaggucaagcugaccaucaugacgggggacaucaagggcaucaugcaggccgggaagcgcucccuccagccgcagcccaccgagcugaaguacagcuggaagaccuggggcaaggccaagaugcuguccaccgagagccacaaccagacguuccucaucgacggccccgagaccgcggagugcccgaacaccaaccgggccuggaacucccuggagguggaggacuacggguucggcguguucaccacgaacaucuggcugaagcuccgcgagaagcaggacgucuucugcgacagcaagcugauguccgccgccaucaaggacaaccgggccgugcacgcggacaugggguacuggaucgagagcgcccugaacgacaccuggaagaucgagaaggccuccuucaucgaggucaagagcugccacuggcccaagucccacacccucuggagcaacggcgugcuggaguccgagaugaucauccccaagaacuucgccggccccgugagccagcacaacuaccgcccgggguaccacacccagaccgccggccccuggcaccuggggaagcucgagauggacuucgacuucugcgagggcacgaccguggucgugaccgaggacugcgggaaccggggccccagccugcgcaccacgaccgcguccggcaagcugaucaccgaguggugcugccggagcugcacccucccgccccugcgcuaccgcggggaggacggcugcugguacgggauggagauccgcccccugaaggagaaggaggagaaccucgugaacucccuggucacggccggccacgggcagaucgacaacuucagccugggcgugcucggcauggcccuguuccuggaggagaugcuccggacccgcguggggaccaagcacgccauccugcuggucgcgguguccuucgugacccucaucacgggcaacaugagcuuccgggaccuggggcgcgucauggugauggugggcgccaccaugaccgacgacaucgggaugggcgucaccuaccuggcccuccuggccgccuucaaggugcggcccacguucgcggccggccugcuccugcgcaagcugaccuccaaggagcucaugaugaccaccaucgggaucgugcugcugagccaguccacgauccccgagaccauccucgagcugaccgacgcccuggcccucggcaugaugguccugaagauggugcgcaagauggagaaguaccagcuggccgugaccaucauggcgauccucugcguccccaacgccgugauccugcagaacgccuggaaggucagcugcacgauccuggccgugguguccgucagcccccucuuccugaccuccagccagcagaaggccgacuggaucccccuggcgcucaccaucaaggggcugaaccccaccgccaucuuccugacgacccucucccggaccaacaagaagcgcagcuggccgcugaacgaggccaucauggccgugggcaugguguccauccuggcgagcucccuccugaagaacgacauccccaugaccggcccccuggucgccgggggccuccugacggugugcuacgugcugaccgggcggagcgccgaccucgagcuggagcgcgccgccgacgucaagugggaggaccaggcggagaucagcggcuccagccccauccuguccaucaccaucagcgaggacggguccaugagcaucaagaacgaggaggaggagcagacccucacgauccugauccggaccggccugcucgugaucuccggccuguucccggugagcauccccaucaccgccgccgccugguaccugugggaggucaagaagcagcgcgccggggugcucugggacgugcccagcccgccgcccgucggcaaggcggagcuggaggacggggccuaccggaucaagcagaagggcauccugggguacagccagaucggcgccggcguguacaaggaggggaccuuccacaccauguggcacgugacgcgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagaccaagcccgggcuguucaagaccaacgccggcaccaucggggccgugucccucgacuucagccccggcacguccggcagccccaucaucgacaagaaggggaaggucgugggccuguacgggaacggcguggucacccgguccggcgccuacgugagcgcgaucgcccagaccgagaaguccaucgaggacaaccccgagaucgaggacgacaucuuccgcaagcggaagcugaccaucauggaccuccaccccggggccggcaagacgaagcgcuaccugcccgccaucgugcgggaggcgaucaagcgcgggcugcggacccugauccucgccccgacccgcgucguggccgccgagauggaggaggcccugcggggccugcccauccgcuaccagacccccgcgauccgggccgagcacacggggcgcgagaucguggaccucaugugccacgccaccuucaccaugcgccugcugagccccguccgggugccgaacuacaaccucaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcugguccagcgggcacgagugggucaccgacuucaagggcaagacggugugguucgugccguccaucaaggccgggaacgacaucgccgccugccugcggaagaacggcaagaaggucauccagcugagccgcaagaccuucgacuccgaguacgugaagacccggaccaacgacugggacuucguggucacgaccgacaucagcgagaugggcgcgaacuucaaggccgagcgcgugaucgacccccggcgcugcaugaagcccgugauccucaccgacggggaggagcgggucauccuggccggccccaugccggugacccacuccagcgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacgcccgagggcaucaucccguccauguucgagcccgagcgcgagaagguggacgccaucgacggcgaguaccggcugcgcggggaggcccgcaagaccuucgucgaccucaugcggcgcggcgaccugcccguguggcuggccuaccggguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgcggccggccggaagucccugacccucaaccugaucacggagaugggccgccugcccaccuucaugacccagaaggcccgggacgcccucgacaaccuggcgguccugcacaccgccgaggccgggggccgcgccuacaaccacgcccucagcgagcugcccgagacgcuggagacccuccugcugcucacccugcuggcgaccgugaccgggggcaucuuccucuuccugauguccggccgggggaucggcaagaugacccuggggaugugcugcaucaucaccgccagcauccuccugugguacgcccagauccagccgcacuggaucgccgccuccaucauccuggaguucuuccucaucgugcugcugauccccgagcccgagaagcagcgcacgccccaggacaaccagcucaccuacgucgugaucgcgauccugacgguggucgccgccaccauggccaacgagaugggcuuccuggagaagaccaagaaggaccucgggcugggcagcaucaccacgcagcagccggagagcaacauccuggacaucgaccuccggcccgccuccgcguggacccuguacgccguggccaccaccuucgugacgcccaugcugcgccacagcaucgagaacuccagcgucaacgugucccucaccgccaucgccaaccaggcgaccgugcugaugggccuggggaagggcuggccccucagcaagauggacaucggggucccgcugcuggccaucggcugcuacucccaggugaaccccaucacccucacggccgcccuguuccugcucguggcgcacuacgccaucaucgggcccggccugcaggccaaggccacccgggaggcccagaagcgcgcggccgccggcaucaugaagaaccccaccgucgacgggaucaccgugaucgaccuggacccgauccccuacgaccccaaguucgagaagcagcucggccaggugaugcugcugguccucugcgugacccaggugcugaugaugcggaccaccugggcccugugcgaggcccucacccuggcgacggggcccaucagcacccugugggagggcaacccggggcgcuucuggaacaccaccaucgccgucuccauggccaacaucuuccggggcagcuaccucgccggcgccgggcugcuguucuccaucaugaagaacacgaccaacacccgccgcggcaccgggaacaucggcgagacgcucggcgagaaguggaagucccggcugaacgcgcugggcaagagcgaguuccagaucuacaagaaguccgggauccaggagguggaccgcacccucgccaaggaggggaucaagcggggcgagaccgaccaccacgccgugucccgcgggagcgccaagcugcggugguucgucgagcgcaacauggugacccccgagggcaagguggucgaccugggcugcgggcggggcgggugguccuacuacugcggcgggcucaagaacgugcgcgaggugaagggccugacgaagggcgggcccggccacgaggagcccaucccgaugagcaccuacggguggaaccugguccggcuccaguccggcguggacguguucuucacgccgcccgagaagugcgacacccugcugugcgacaucggggagagcagccccaacccgacggucgaggcgggccgcacccuccgggugcugaaccugguggagaacuggcucaacaacaacacccaguucugcaucaagguccugaaccccuacaugcccuccgugaucgagaagauggaggcccugcagcgcaaguacggcggggcccucgugcggaacccgcugagccgcaacuccacccacgagauguacugggucagcaacgccuccggcaacaucgugagcuccgugaacaugaucagccggaugcugaucaaccgcuucaccaugcggcacaagaaggccacguacgagcccgacgucgaccugggguccggcacccgcaacaucgggaucgagagcgagauccccaaccucgacaucaucggcaagcggaucgagaagaucaagcaggagcacgagaccuccuggcacuacgaccaggaccaccccuacaagaccugggcguaccacggcagcuacgagacgaagcagaccggguccgccagcuccauggugaacggcgugguccgccugcugaccaagccgugggacguggugcccauggucacccagauggccaugacggacaccacccccuucgggcagcagcgcguguucaaggagaagguggacacccggacgcaggagcccaaggagggcaccaagaagcucaugaagaucaccgccgaguggcuguggaaggagcugggcaagaagaagaccccgcgcaugugcacgcgggaggaguucacccgcaagguccggagcaacgccgcgcucggggccaucuucaccgacgagaacaaguggaaguccgcccgcgaggccguggaggacagccgguucugggagcuggucgacaaggagcgcaaccugcaccucgagggcaagugcgagaccugcguguacaacaugauggggaagcgggagaagaagcugggcgaguucgggaaggccaagggcucccgcgcgaucugguacauguggcugggcgcccgguuccucgaguucgaggcccugggguuccugaacgaggaccacugguucagccgcgagaacagccucuccggcguggagggggagggccugcacaagcugggguacauccuccgggacgucagcaagaaggagggcggcgccauguacgcggacgacacggccgggugggacacccgcaucacccuggaggaccugaagaacgaggagauggugaccaaccacauggagggcgagcacaagaagcucgccgaggccaucuucaagcugacguaccagaacaaggugguccgggugcagcgccccacgccccgggggaccgugauggacaucaucucccgccgggaccagcgcggcagcgggcaggucggcaccuacggccugaacaccuucaccaacauggaggcccagcucauccggcagauggagggggagggcguguucaaguccauccagcaccugaccgugaccgaggagaucgcgguccagaacuggcuggcccgcguggggcgcgagcggcucagccgcauggccaucuccggcgacgacugcguggucaagccccuggacgaccgguucgccagcgcccugacggcgcucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugccgaccucccgcacgaccuggagcauccacgccaagcacgaguggaugaccaccgaggacaugcucaccguguggaaccgggucuggauccaggagaaccccuggauggaggacaagacgcccguggagagcugggaggagauccccuaccugggcaagcgcgaggaccaguggugcgggucccugaucggccucaccagccgggcgaccugggccaagaacauccagaccgccaucaaccaggugcgcucccugaucgggaacgaggaguacacggacuacaugccgagcaugaagcgguuccgccgcgaggaggaggaggccggcguccugugguga

SEQ ID NO: 9316 - RNA, 9876 nt, Artificial Sequence
  derived and/or modified CDS sequence (opt1) from DENV-2__KF360005__SS-prME
accgccggggugaucaucaugcggauccccaccgccauggcguuccaccugaccacccggaacggggagccccacaugaucgugagcaagcaggagaagggcaagucccuccuguucaagaccgaggacggggugaacaugugcacccugauggccauggaccucggcgagcugugcgaggacaccaucaccuacaacugcccccugcuccggcagaacgagcccgaggacaucgacugcuggugcaacagcaccuccaccugggugaccuacgggaccugcaccgccaccggcgagcaccggcgggagaagcggagcgucgcccuggugccccacgugggcauggggcuggagacccgcaccgagaccuggauguccagcgagggcgccuggaagcacgcgcagcggaucgagaccuggauccuccgccaccccggguucaccaucauggccgccauccuggccuacaccaucggcaccaccuacuuccagcggguccugaucuucauccuccugacggcgguggcccccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcagcccgccacccugcgcaaguacugcaucgaggcgaagcucaccaacacgaccaccgccagccggugcccgacccagggggagcccucccugaacgaggagcaggacaagcgcuucgugugcaagcacagcauggugggccggggcuggggcgacggcugcgggcuguucggcaagggcgggaucgucacgugcgccauguucacgugcaagaagaacauggaggggaagaucgugcagcccgagaaccucgaguacaccaucguggucacgccccacuccggggaggagaacgccgugggcaacgacacggggaagcacggcaaggagaucaaggugaccccgcagagcuccaucaccgaggccgagcugaccggguacggcaccgucacgauggagugcagcccccgcaccggccuggacuucaacgagauggugcuccugcagauggagaacaaggcguggcuggugcaccggcagugguuccucgaccugccccugcccuggcucccgggggccgacauccagggcuccaacuggauccagaaggagacccuggucaccuucaagaacccccacgccaagaagcaggacguggucgugcuggggagccaggagggcgcccuccacacggcccugaccggggcgaccgagauccagaugagcuccggcaaccugcuguucaccggccaccugaagugccgccugcggauggacaagcuccagcugaaggggaugagcuacuccaugugcacgggcaaguucaagguggucaaggagaucgccgagacccagcacgggaccaucguggugcgcauccaguacgagggcgacggcagccccugcaagauccccuucgagaucauggaccuggagaagcggcacguccucgggcgccugaucaccgugaacccgaucgugacggagaaggacucccccgucaacaucgaggccgagccgcccuucggcgacagcuacaucaucaucgggguggagccgggccagcugaagcucuccugguucaagaaggggagcuccaucggccagauguucgagaccaccaugcgcggcgccaagcggauggccauccugggggacaccgcgugggacuucggcagccucggcgggguguucacguccaucgggaaggcccuccaccaggucuucggggccaucuacggcgccgcguucagcgggguguccuggaccaugaagauccugaucggcguggucaucaccuggaucgggaugaacagccgcuccaccagccuguccgugagccuggugcucgucggcguggugacgcuguaccugggggucauggugcaggccgacuccggcugcguggucagcuggcggaacaaggagcucaagugcggcagcgggaucuucaucaccgacaacgugcacaccuggaccgagcaguacaaguuccagcccgagucccccagcaagcuggccuccgccauccagaaggcccacgaggagggcaucugcgggauccgcagcgugacgcggcuggagaaccucauguggaagcagaucacccccgagcugaaccacauccuguccgagaacgaggucaagcucagcaucaugaccggcgacaucaaggggaucaugcaggcgggcaagcgcucccugcggccgcagcccaccgagcugaaguacagcuggaagacguggggcaaggccaagaugcucuccaccgagccccacaaccagaccuuccugaucgacgggccggagaccgccgagugccccaacacgaaccgcgccuggaacagccuggagguggaggacuacggcuucgggguguucaccaccaacaucuggcucaagcugaaggagcggcaggacgucuucugcgacuccaagcugaugagcgccgcgaucaaggacaaccgcgccgugcacgccgacaugggcuacuggaucgaguccgcccucaacgacaccuggaagaucgagaaggccagcuucaucgaggugaaguccugccacuggcccaagagccacacgcugugguccaacggcguccuggagagcgagaugaucauccccaagaacuucgcggggccggugagccagcacaacuaccggcccggcuaccacacccagaccgccgggcccuggcaccucggcaagcuggagauggacuucgacuucugcgaggggaccaccguggucgugacggaggacugcggcaaccgcggccccucccugcggaccaccaccgccagcgggaagcucaucacggaguggugcugccgcuccugcacccugccgccccugcgguaccgcggcgaggacgggugcugguacggcauggagauccggccccucaaggagaaggaggagaaccuggugaacagccuggucaccgccgggcacggccagaucgacaacuucucccucggcgugcuggggauggcgcuguuccucgaggagaugcugcgcacccgggugggcacgaagcacgccguccugcucguggccgugagcuucaugacccugaucaccgggaacauguccuuccgcgaccugggccgcgucauggugauggugggggccgccaugaccgacgacaucggcaugggcgucacguaccucgcgcugcuggccgccuucaaggugcggcccaccuucgccgccgggcuccugcugcgcaagcucaccagcaaggagcugaugaugaccacgaucggcaucgugcugcucucccagagcaccaccccggagaccauccuggagcugacggacgcgcucgcccuggggaugaugauccugaagaucguccggaacauggagaaguaccagcucgccgugaccaucauggccauccugugcguccccaacgccgugauccugcagaacgcguggaagguguccugcaccauccucgccgccgucagcgugagcccccugcugcucaccagcucccagcagaaggccgacuggaucccccuggcgcugacgaucaagggccucaacccgaccgccaucuuccugaccacccugagccgcacgaacaagaagcgguccuggccccucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgacgugcgcugggaggaccaggccgagguguccgggagcuccccgauccugagcaucacgaucuccgaggacggcagcauguccaucaagaacgaggaggaggagcagacccugaccauccucauccggaccggccugcuggucaucagcggccucuuccccguguccauccccaucacggcggccgccugguaccugugggaggugaagaagcagcgcgccggcguccugagcgccgugcccuccccgccgcccguggggaaggcggagcucgaggacggcgccuaccggaucaagcagaaggggauccugggcuacagccagaucggcgccggggucuacaaggagggcaccuuccacaccauguggcacgugacccgcggggccgugcugaugcacaagggcaagcggaucgagccguccugggccgacguccgcaaggaccucaucagcuacgggggcggccggaagcuggagggggaguggaaggagggcgaggagguccaggugcuggcgcucgagcccgggaagaacccccgcgccguccagaccaagcccggccuguucaagacgaacaccgggaccaucggcgccgugucccuggacuucagcccgggcgccuccgggagccccaucguggacaagaagggcaaggucguggggcucuacggcaacggcguggucacccgguccgggacguacgugagcgcgaucgcccagaccgagaaguccaucgaggacaaccccgagaucgaggacgacaucuuccgcaagaagcggcugaccaucauggaccugcaccccggcgccgggaagaccaagcgcuaccugccggccaucgugcgggaggccaucaagcgcggccuccgcacgcugauccuggcgcccacccgggucguggccgccgagauggaggaggcccuccgcgggcugcccauccgguaccagacccccgccauccgcgcggagcacaccggccgggagaucguggaccugaugugccacgccacguucaccaugcgccuccuguccccgguccgggugcccaacuacaaccugaucaucauggacgaggcccacuucaccgaccccgccagcaucgccgcgcgcggcuacaucuccacccggguggagaugggggaggccgccggcaucuucaugacggccacgccgcccgggagccgcgaccccuucccccaguccaacgcgcccaucauggacgaggagcgggagauccccgagcgcagcuggaacuccggccacgagugggucaccgacuucaaggggaagaccgugugguucgugcccagcaucaaggccggcaacgacaucgccgccugccuccggaagaacggcaagaaggucauccagcugucccgcaagacguucgacagcgaguacaucaagacccggaccaacgacugggacuucguggugaccacggacaucuccgagaugggggccaacuucaaggcggagcgcgucaucgacccccggcgcugcaugaagcccgugauccugaccgacggcgaggagcgggugauccucgccgggccgaugcccgucacccacagcuccgccgcccagcgccgcggccggaucgggcgcaaccccaagaacgagaacgaccaguacaucuacaugggcgagccccuggagaacgacgaggacugcgcccacuggaaggaggcgaagaugcugcucgacaacaucaacaccccggagggcaucauccccagcauguucgagcccgagcgggagaagguggacgccaucgacggggaguaccgccugcggggcgaggcccgcaagacguucguggaccugaugcggcgcggggaccucccggucuggcuggccuaccggguggccgcggagggcaucaacuacgccgaccgccgguggugcuucgacgggaucaagaacaaccagauccuggaggagaacgucgagguggagaucuggaccaaggagggcgagcgcaagaagcucaagccccgguggcuggacgcccgcaucuacuccgacccccuggcccucaaggaguucaaggaguucgcggccggccgcaagagccugacccugaaccucaucaccgagauggggcgccugcccacguucaugacccagaaggcccggaacgcccuggacaaccucgccgugcugcacaccgcggaggccggcgggcgcgccuacaaccacgcccuguccgagcucccggagacccuggagacgcugcuccugcugacccuccuggccaccgucaccggcggcaucuuccuguuccucaugagcgggaagggcaucgggaagaugacgcugggcaugugcugcaucaucaccgcguccauccugcucugguacgcccagauccagccccacuggaucgccgccagcaucauccuggaguucuuccugaucgugcuccugauccccgagcccgagaagcagcggaccccgcaggacaaccagcugaccuacguggucaucgccauccucaccgugguggcggccacgauggccaacgagaugggguuccuggagaagaccaagaaggacuucggccugggcagcaucgccacccagcagcccgaguccaacauccucgacaucgaccugcgccccgccagcgcguggacccuguacgccgucgccacgaccuucaucacccccaugcuccggcacuccaucgagaacagcuccgugaacgugagccugaccgccaucgcgaaccaggccacgguccugauggggcucggcaagggguggccgcuguccaagauggacaucggcgugccccugcucgccaucgggugcuacagccaggugaaccccaucacccugaccgccgcccugcuccugcuggucgcgcacuacgccaucaucggccccggccuccaggccaaggccacccgcgaggcccagaagcgcgcggccgccgggaucaugaagaacccgacggccgacggcaucaccgugaucgaccuggaccccauccccuacgaccccaaguucgagaagcagcugggccaggugaugcuccugguccugugcgugacccaggugcucaugaugcggaccacgugggcccugugcgaggcgcugacccucgccaccggcccgaucuccacccugugggaggggagccccggccgcuucuggaacacgaccaucgccgucuccauggccaacaucuuccggggcagcuaccuggcgggggccggccuccuguucuccaucaugaagaacaccaccaacacgcgccgggggaccggcaacaccggcgagacccugggggagaaguggaagaaccgccucaacagccugggcaaguccgaguuccagaucuacaagcggagcgggauccaggagguggaccgcacgcuggccaaggagggcaucaagcgcggggagaccgaccaccacgccgugucccgcggcagcgccaagcuccggugguucgucgagcgcaaccuggugacccccgagggcaagguggucgaccuggggugcggccgcggcgggugguccuacuacugcggcgggcucaagaacgugcgcgaggugcgggggcugaccaagggcgggcccgggcacgaggagccgauccccaugagcacguacggcuggaaccugguccgccuccagagcgggguggacguguucuucacgccgcccgagaagugcgacacccugcugugcgacaucggcgaguccagcccgaaccccaccgucgaggcgggccggacgcuccgcgugcugaaccugguggagaacuggcucaacaacaacacccaguucugcaucaagguccugaaccccuacaugccguccgugaucgagaagauggagacccugcagcggaaguacgggggcgcccuggugcgcaacccccucagccgcaacuccacccacgagauguacugggucagcaacgccuccgggaacaucgugagcuccgugaacaugaucagccggaugcugaucaaccgcuucaccaugcggcacaagaaggccacguacgagcccgacgucgaccugggcuccgggacccgcaacaucggcaucgagagcgagacccccaaccucgacaucaucggcaagcggaucgagaagaucaagcaggagcacgagaccuccuggcacuacgaccaggaccacccguacaagacgugggccuaccacgggagcuacgagaccaagcagaccggcuccgcgagcuccguggugaacggggucgugcgccugcugaccaagcccugggacgugauccccauggucacgcagauggccaugaccgacaccacccccuucggccagcagcggguguucaaggagaagguggacacgcgcacccaggagccgaaggagggcaccaagaagcucaugaagaucaccgccgaguggcuguggaaggagcuggggaagaagaagacgccccggaugugcacccgcgaggaguucgcccggaagguccgcagcaacgccgcgcucggcgccaucuucaccgacgagaacaaguggaaguccgcccgggaggccguggaggacagccgcuucugggagcuggucgacaaggagcggaaccugcaccucgaggggaagugcgagaccugcguguacaacaugaugggcaagcgcgagaagaagaucggggaguucggcaaggcgaagggcagccgggccgugugguacauguggcugggggcccgcuuccuggaguucgaggcccucggcuuccugaacgaggaccacugguucucccgggagaacagccuguccggggucgagggcgaggggcuccacaagcugggcuacauccugcgcgaggugagcaagaaggagggcggggccauguacgcggacgacacggccggcugggacacccggaucacccucgaggaccugaagaacgaggagauggugaccaaccacauggagggggagcacaagaagcuggccgaggccaucuucaagcucacguaccagaacaaggucgugcgcgugcagcgccccacgccccggggcaccgucauggacaucaucucccgccgggaccagcgcagcuccggccaggugggcaccuacggccugaacacguucaccaacaugggggcccagcugauccggcagauggagggcgaggggguguucaagggcauccagcaccucaccgcgaccgaggaggucgccgugcaggacuggcuggcccgcgugggccgggagcgccugagccggauggccaucuccggggacgacugcgucgugaagccgcucgacgaccgcuucgccagcgcgcugacggcccugaacgacaugggcaaggugcggaaggacauccagcagugggagcccucccgcggguggaacgacuggacccagguccccuucugcagccaccacuuccacgagcucaucaugaaggacggccgggugcuggugguccccugccgcaaccaggacgagcugaucgggcgggcccgcaucucccagggcgccggcuggagccuccgggagaccgccugccuggggaaguccuacgcgcagauguggagccugauguacuuccaccgccggggccuccgccuggccgccaacgccaucugcuccgcggugccgagccacugggugcccaccagccgcacgaccugguccauccacgcccggcacgaguggaugaccaccgaggacaugcugaccgucuggaaccgcguguggauccaggagaaccccuggauggaggacaagacgcccguggagagcugggaggagaucccguaccucgggaagcggggcgaccaguggugcgggucccugaucggccugaccagccgcgccaccugggcccggaacauccagaccgccaucaaccgcguccggucccucaucggcagcgagggguacacggacuacaugcccuccaugaagcgcuuccggcgcgaggaggacgaggcgggcgugcugugguga

SEQ ID NO: 9317 - RNA, 9876 nt, Artificial Sequence
  derived and/or modified CDS sequence (opt1) from DENV-2__KJ010185__SS-prME
accgcgggcgugaucaucaugcugauccccaccgccauggcguuccaccucaccacccgcaacggggagccccacaugaucgucagcaagcaggagaagggcaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacgccaccuccaccugggugaccuacgggaccugcaccgccaccggcgagcaccgccgggagaagcgcuccgucgcccuggugccccacgugggcauggggcucgagacccggaccgagaccuggaugagcuccgagggcgcguggaagcacgcccagcgcaucgagaccuggauccugcggcacccgggguucacgaucauggccgccauccuggcguacaccaucggcaccaccuacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggccaagaacaagcccacgcuggacuucgagcugaucaagaccgaggccaagcagcccgcgacccuccggaaguacugcaucgaggccaagcugaccaacacgaccaccgccucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagaacgccguggggaacgacacgggcaagcacgggaaggagaucaaggugaccccgcaguccagcaucaccgaggcggagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacauccaggggagcaacuggauccagaaggagacccuggucaccuucaagaacccccacgccaagaagcaggacguggucgugcucggcucccaggagggggccaugcacacggcgcugaccggcgccaccgagauccagaugagcagcgggaacccccuguucaccggccaccucaagugccggcugcgcauggacaagcugcagcucaagggcauguccuacagcaugugcacggggaaguucaagguggucaaggagaucgccgagacccagcacggcaccaucguggugcggauccaguacgagggggacggcucccccugcaagaucccguucgagaucauggaccuggagaagcgccacguccugggccggcucaucaccgugaaccccaucgugacggagaaggacagccccgucaacaucgaggccgagcccccguucggggacuccuacaucaucaucggcguggagcccgggcagcugaagcugagcugguucaagaagggcuccagcaucgggcagauguucgagaccaccaugcgcggcgccaagcgcauggcgauccucggcgacaccgccugggacuucgggucccugggcgggguguucacgagcaucggcaaggcccugcaccaggucuucggggccaucuacggcgcggccuucuccggcgugagcuggaccaugaagauccucaucgggguggucaucaccuggaucggcaugaacucccggagcaccucccugagcgugucccuggugcuggucgggguggugacgcucuaccugggcgucauggugcaggccgacagcgggugcguggucuccuggaagaacaaggagcugaagugcggcagcggcaucuucuucaccgacaacgugcacaccuggaccgagcaguacaaguuccagcccgagagccccuccaagcucgccagcgccauccagaaggcgcacgaggaggggaucugcggcauccgcuccaucacgcggcuggacaaccugauguggaagcagaucaccccggagcucaaccacauccugagcgagaacgaggugaagcuguccaucaugaccggggacaucaagggcaucaugcaggccgggaagcgcagccuccggccccagcccaccgagcugaaguacuccuggaagacguggggcaaggccaagaugcugagcaccgagccgcacaaccagaccuuccucaucgacggccccgagaccgcccagugccccaacacgaaccgcgccuggaacucccuggaggucgaggacuacggguucggcguguucaccaccaacaucuggcugaagcucaaggagcggcaggacguguucugcgacagcaagcugauguccgcggccaucaaggacaaccgcgccguccacgccgacaugggguacuggaucgagagcgcccugaacgacaccuggaagaucgagaaggcguccuucaucgaggucaagagcugccacuggcccaagucccacacgcucuggagcaacggcgugcuggaguccgagaugaucaucccgaagaacuucgccggccccgugagccagcacaacuaccggcccggguaccacacccagaccgccggccccuggcaccuggggaagcucgagauggacuucgacuucugcgagggcaccaccgugguggucacggaggacugcgggaaccgcggcccgagccugcggaccaccaccgccuccggcaagcugaucacggaguggugcugccgcagcugcacccugccgccccuccgguaccgcggggaggacggcugcugguacgggauggagauccggccccugaaggagaaggaggagaaccucgugaacucccuggugaccgcgggccacgggcagaucgacaacuucagccugggcguccucggcauggcccuguuccuggaggagaugcuccgcacccggguggggacgaagcacgccgugcugcuggucgccguguccuucaugacccucaucaccggcaacaugagcuuccgcgaccuggggcgggugauggucauggugggcgccgcgaugaccgacgacaucgggaugggcgugacguaccuggcccuccuggccgccuucaagguccgcccgaccuucgccgcgggccugcuccugcgcaagcugaccuccaaggagcucaugaugaccacgaucgggaucgugcugcugagccaguccaccacccccgagaccauccucgagcugacggacgcccuggcccucggcaugaugauccugaagaucgugcggaacauggagaaguaccagcuggccgucaccaucauggccauccucugcgugcccaacgcggucauccugcagaacgccuggaaggugagcugcaccauccuggccgccguguccgucagcccccuccugcugaccuccagccagcagaaggcggacuggaucccgcucgcccugacgaucaaggggcugaaccccaccgccaucuuccucaccacccugucccgcacgaacaagaagcggagcuggccccugaacgaggccaucauggccgugggcaugguguccauccucgcgagcucccugcugaagaacgacauccccaugaccggcccgcucgucgccgggggccugcugaccgugugcuacgugcucaccgggcgcagcgccgaccuggagcuggagcgggccgccgacguccgcugggaggaccaggcggagaucagcggcuccagccccauccucuccaucacgaucagcgaggacggguccaugagcaucaagaacgaggaggaggagcagacccugaccauccugauccggaccggccuccuggugaucuccggccuguuccccgugagcauccccaucacggccgccgccugguaccucugggaggucaagaagcagcgcgccggggugcugugggacgugccgagcccgccgcccgucggcaaggcggagcuggaggacggggccuaccggaucaagcagaagggcauccucggguacagccagaucggcgccggcguguacaaggaggggaccuuccacaccauguggcacgugacccgcggcgccguccugaugcacaaggggaagcggaucgagcccuccugggccgacgugcgcaaggaccugaucagcuacggcgggggcuggaagcucgagggcgaguggaaggagggggaggaggugcagguccuggcgcuggagcccggcaagaacccccgggccgugcagaccaagcccggccuguucaagacgaacaccggcaccaucggggccgugucccuggacuucagccccggcaccuccggcagccccaucgucgacaagaaggggaagguggugggccuguacgggaacggcgucgugacgcgcuccggcaccuacgugagcgccaucgcgcagaccgagaaguccaucgaggacaaccccgagaucgaggacgacaucuuccggaagaagcgccucaccaucauggaccugcacccgggggccggcaagacgaagcgguaccugcccgccaucguccgcgaggccaucaagcgggggcugcgcacccucauccuggcccccacccgggugguggcggccgagauggaggaggcccugcgcggccuccccauccgcuaccagaccccggccauccgggccgagcacacggggcgcgagaucgucgaccugaugugccacgcgaccuucaccaugcggcugcucagccccgugcgcgugcccaacuacaaccugaucaucauggacgaggcccacuucaccgaccccgccagcaucgccgcccggggcuacaucuccacgcgcgucgagaugggcgaggcggccgggaucuucaugaccgccaccccgcccggcagccgggaccccuucccccaguccaacgccccgaucauggacgaggagcgcgagauccccgagcggagcuggaacuccgggcacgagugggugaccgacuucaagggcaagacggugugguucguccccagcaucaaggcggggaacgacaucgccgccugccugcgcaagaacggcaagaaggugauccagcucucccggaagaccuucgacagcgaguacaucaagacccgcaccaacgacugggacuucguggucacgaccgacaucuccgagaugggcgccaacuucaaggccgagcgggugaucgacccccgccggugcaugaagccggugauccugaccgacggggaggagcgcgucauccuggcgggccccaugcccgugacccacagcuccgccgcccagcggcgcgggcggaucggccgcaaccccaagaacgagaacgaccaguacaucuacaugggggagccgcucgagaacgacgaggacugcgcccacuggaaggaggccaagaugcugcuggacaacaucaacacgcccgagggcaucauccccagcauguucgagccggagcgcgagaagguggacgcgaucgacggcgaguaccggcuccgcggggaggcccggaagaccuucgucgaccugaugcgccggggcgaccugcccguguggcucgccuaccgcguggccgccgaggggaucaacuacgcggaccggcgcuggugcuucgacggcaucaagaacaaccagauccuggaggagaacgucgagguggagaucuggaccaaggagggggagcggaagaagcugaagccccgcuggcucgacgcccggaucuacuccgacccccuggcccugaaggaguucaaggaguucgccgcgggccgcaagagccucacccugaaccugaucacggagaugggccggcucccgaccuucaugacccagaaggcccgcaacgcccuggacaaccuggccguccuccacaccgccgaggccggcgggcgggccuacaaccacgcccuguccgagcugcccgagacgcucgagacccugcugcuccugacccugcucgccaccgugaccggcgggaucuuccuguuccugaugagcgggaaggggaucggcaagaugacccucgggaugugcugcaucaucaccgccuccauccugcugugguacgcgcagauccagccccacuggaucgccgccagcaucauccucgaguucuuccugaucgugcugcucauccccgagccggagaagcagcgcacgccccaggacaaccagcugaccuacgucgugaucgccauccugacgguggucgccgcgaccauggccaacgagaugggcuuccucgagaagaccaagaaggacuucgggcugggcuccaucgccacccagcagcccgagagcaacauccuggacaucgaccuccggcccgccagcgccuggacgcuguacgcgguggccaccaccuucaucaccccgaugcugcgccacuccaucgagaacagcuccgugaacgucagccucacggccaucgccaaccaggcgaccgugcugaugggccuggggaagggcuggccccucuccaagauggacaucggggugccccugcuggccaucggcugcuacagccaggucaaccccaucacccucaccgccgcccugcugcuccugguggcccacuacgcgaucaucgggccgggccugcaggccaaggccucccgggaggcccagaagcgcgccgcggccggcaucaugaagaaccccacgguggacgggaucaccgucaucgaccucgaccccauccccuacgacccgaaguucgagaagcagcugggccaggugaugcugcucauccugugcgugacccagguccugaugaugcggaccacgugggcccucugcgaggcccugacccuggccaccgggcccaucagcacccucugggagggcaaccccgggcgcuucuggaacacgaccaucgcgguguccauggccaacaucuuccgcggcagcuaccuggccggcgccgggcuccucuucuccaucaugaagaacaccaccaacacgcggcgcggcaccgggaacaccggcgagacccugggcgagaaguggaagaaccgggugagccugcucgggaaguccgaguuccagaucuacaagcgcagcggcauccaggaggucgaccggacgcuggcgaaggaggggaucaagcgcggcgagaccgaccaccacgccgugucccgggggagcgccaagcugcgcugguucguggagcggaaccucgucacccccgagggcaaggugguggaccugggcugcgggcgcggcgggugguccuacuacugcggcgggcugaagaacguccgggaggugaagggccucaccaagggcgggccgggccacgaggagcccauccccaugagcacguacggguggaaccuggugcgccugcucaccggcgccgacgucuucuucacgcccccggagaagugcgacacccugcugugcgacaucggggaguccagccccaaccccacgguggaggccggccggacccuccgcgugcugaaccuggucgagaacuggcucaacaacaacacccaguucugcaucaaggugcugaacccguacaugcccagcgugaucgagaagauggagacccugcagcggaaguacggcggggcgcugguccgcaacccccucucccggaacagcacccacgagauguacuggguguccaacgccagcggcaacaucguguccagcgucaacaugaucucccgcaugcugaucaaccgguucacgaugcgccacaagaaggccaccuacgaccccgacguggaccuggggagcggcacccgcaacaucgggaucgaguccgagaccccgaaccucgacaucaucggcaagcggaucgagaagaucaagcaggagcacgagacgagccgccacuacgaccaggaccaccccuacaagaccugggccuaccacggcuccuacgagaccaagcagaccgggagcgccuccagcacggugaacggcgucgugcggcugcugaccaagcccugggacgugauccccauggucacccagauggcgaugaccgacacgaccccguucgggcagcagcgcguguucaaggagaagguggacacccggacccaggagcccaaggagggcacgaagaagcucaugaagaucaccgccgaguggcuguggaaggagcugggcaagaagaagacgccccgcaugugcacccgggaggaguucgcccgcaagguccgguccaacgccgcccucggggcgaucuucacggacgagaacaaguggaaguccgcccgcgaggccguggaggacucccgguucugggagcugguggacaaggagcgcaaccugcaccucgagggcaagugcgagaccugcgucuacaacaugauggggaagcgggagaagaagaucggcgaguucgggaaggccaagggcagccgcgcgaucugguacauguggcugggcgcccgguuccuggaguucgaggcccucggguuccugaacgaggaccacugguucucccgcgagaacagccugagcggcguggagggggagggccuccacaagcugggguacauccugcgggaggucuccaagaaggagggcggcgccauguacgccgacgacaccgcggggugggacacccgcaucacgcucgaggaccugaagaacgaggagauggugaccaaccacauggagggcgagcacaagaagcuggccgaggccaucuucaagcucaccuaccagaacaaggugguccgggugcagcgccccaccccgcgggggacggugauggacaucaucagccgccgcgaccagcggggcuccguccagguggggaccuacggccugggcaccuucaccaacaugggggcccagcugauccgccagauggagggcgaggggguguucaagggcauccagcaccucacggccaccgaggaggucgcggugcaggacuggcuggcccgggugggccgcgagcggcugagccgcauggccaucuccggggacgacugcgucgugaagccccucgacgaccgguucgccagcgcccugaccgcgcugaacgacaugggcaaggugcgcaaggacauccagcagugggagcccucccggggguggaacgacuggacccagguccccuucugcagccaccacuuccacgagcucaucaugaaggacggccgcgugcugguggucccgugccggaaccaggacgagcugaucgggcgcgcccggaucucccagggcgccggcuggagccuccgcgagacggccugccuggggaaguccuacgcccagauguggagccugauguacuuccaccggcgcgaccuccggcuggcggccaacgccaucugcuccgccgugcccagccacugggugcccaccucccgcaccaccuggagcauccacgcgggccacgaguggaugaccacggaggacaugcugaccgucuggaaccggguguggauccaggagaaccccuggauggaggacaagaccccgguggaguccugggaggagauccccuaccucgggaagcgcgaggaccaguggugcggcagccugaucgggcugaccagccgcgccacgugggcccggaacauccagaccgccaucaaccagguccgcucccucaucggcagcgaggaguacaccgacuacaugcccuccaugaagcgguucggccgcgaggaggaggaggccggggugcugugguga

SEQ ID NO: 9318 - RNA, 9876 nt, Artificial Sequence
  derived and/or modified CDS sequence (opt1) from DENV-2__KJ010186__SS-prME
accgccggcgugaucaucaugcugauccccaccgccauggcguuccaccucaccacccgcaacggggagccgcacaugaucguguccaagcaggagaagggcaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacgccaccagcaccugggugaccuacgggaccugcaccgccaccggcgagcaccgccgggagaagcgcuccgucgcccuggugccccacgugggcauggggcucgagacccggaccgagaccuggaugagcuccgagggcgcguggaagcacgcccagcgcaucgagaccuggauccugcggcaccccggguucaccaucauggccgccauccuggcguacaccaucggcaccaccuacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggccaagaacaagcccacgcuggacuucgagcugaucaagaccgaggccaagcagcccgcgacccuccggaaguacugcaucgaggcccgccugaccaacacgaccaccgccucccggugcccgacccagggggagcccagccugaacgaggagcaggacaagcgcuucgugugcaagcacuccaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagaacgccguggggaacgacacgggcaagcacgggaaggagaucaaggugaccccgcaguccagcaucaccgaggcggagcugaccggcuacgggaccgucacgauggagugcagcccccggaccggccucgacuucaacgagauggugcugcugcagauggagaacaaggccuggcucgugcaccggcagugguuccuggaccugccccuccccuggcugccgggcgccgacauccaggggagcaacuggauccagaaggagacccuggucaccuucaagaagccccacgccaagaagcaggacguggucgugcucggcucccaggagggggccaugcacacggcgcugaccggcgccaccgagauccagaugagcagcgggaaccuccuguucaccggccaccugaagugccgccugcggauggacaagcuccagcugaagggcauguccuacagcaugugcacggggaaguucaagguggucaaggagaucgccgagacccagcacggcaccaucguggugcgcguccaguacgagggggacggcucccccugcaagauccccuucgagaucauggaccuggagaagcggcacgugcucggccgccugaucaccgugaacccgaucgucacggagaaggacagccccgugaacaucgaggccgagccgcccuucggggacuccuacaucaucaucggcguggagccggggcagcugaagcucagcugguucaagaagggcuccagcaucgggcagauguucgagaccaccaugcgcggcgccaagcggauggcgauccugggcgacaccgccugggacuucgggucccugggcggggucuucacgagcaucggcaaggcccuccaccagguguucggggccaucuacggcgcggccuucuccggcgugagcuggaccaugaagauccugaucggggucgugaucaccuggaucggcaugaacucccgcagcaccucccugagcgugucccugguccucguggggguggucacgcuguaccugggcgugauggugcaggccgacagcgggugcgucguguccuggaagaacaccgcccucaagugcggcagcggcaucuucaucaccgacaacgugcacaccuggacggagcaguacaaguuccagcccgagagccccuccaagcuggccagcgcgauccagaaggcccacgaggaggggaucugcggcauccgguccgucacccgccuggagaaccucauguggaagcagaucacccccgagcugaaccacauccugagcgagaacgaggugaagcucuccaucaugaccggggacaucaagggcauccugcaggccgggaagcggagccugcgcccgcagcccacggagcucaaguacuccuggaagaccuggggcaaggccaagaugcugagcaccgagucccacaaccagaccuuccugaucgacggccccgagacggccgagugcccgaacaccaaccgggcguggaacagccucgagguggaggacuacggguucggcgucuucaccaccaacaucuggcugaagcugaaggagcgccaggacguguucugcgacuccaagcucaugagcgccgccaucaaggacaaccgggccgugcacgccgacaugggguacuggaucgaguccgcgcugaacgacacguggaagaucgagaaggccagcuucaucgaggucaaguccugccacuggcccaagagccacacccugugguccaacggcgugcucgagagcgagaugaucauccccaagaacuucgccggccccgugagccagcacaacuaccgcccgggguaccacacccagaccgccggccccuggcaccuggggaagcuggagauggacuucgacuucugcgagggcaccacggucguggugaccgaggacugcgggaaccggggccccucccuccgcaccaccacggcgagcggcaagcugaucaccgaguggugcugccgguccugcacccugcccccgcuccgcuaccgcggggaggacggcugcugguacgggauggagauccgcccccugaaggagaaggaggagaaccuggucaacagccucgugaccgccggccacgggcagaucgacaacuucucccugggcgugcugggcauggcccucuuccuggaggagaugcugcggacgcgcgucgggaccaagcacgccgugcuccugguggccgucagcuucaugacccugaucaccggcaacauguccuuccgggaccucgggcgcgugauggugauggucggcgcggccaugacggacgacaucgggaugggcgugaccuaccuggcccugcucgccgccuucaaggugcgccccaccuucgcggccggccugcugcuccggaagcugaccagcaaggagcugaugaugacgaccaucgggaucguccuccugucccagagcaccacccccgagacgauccuggagcucaccgacgcccuggcccugggcaugaugauccucaagaucgugcgcaacauggagaaguaccagcuggccgucaccaucauggcgauccugugcgugccgaacgccgugauccuccagaacgccuggaaggucuccugcaccauccuggccgcggugagcgugagcccccugcuccugacgagcucccagcagaaggccgacuggaucccccuggcccucaccaucaaggggcugaaccccaccgccaucuuccugaccacgcucagccggaccaacaagaagcgcuccuggccgcugaacgaggccaucauggcggucggcauggugagcauccuggccuccagccuccugaagaacgacauccccaugaccggcccccugguggccgggggccuccugaccgucugcuacgugcugacggggcggagcgccgaccucgagcuggagcgcgccgcggacgugcggugggaggaccaggccgagaucuccggcagcucccccauccugagcaucaccaucuccgaggacgggagcauguccaucaagaacgaggaggaggagcagacccucaccauccugauccgcacgggccugcucgucaucagcggccuguucccgguguccauccccaucaccgccgccgccugguaccugugggaggugaagaagcagcgggcggggguccucugggacgugcgcagcuacccgcccgugggcaaggccgagcuggaggacggggccuaccggaucaagcagaagggcauccugggguacucccagaucggcgccggcgucuacaaggaggggaccuuccacaccauguggcacgugacccgcggcgccgugcucaugcacaaggggaagcggaucgagccgagcugggcggacguccgcaaggaccugaucuccuacggcgggggcuggaagcuggagggcgaguggaaggagggggaggagguccaggugcucgcccuggagcccggcaagaacccccgggccguccagacgaagccggggcuguucaagaccaacaccggcaccaucggggccgugagccucgacuucucccccggcacgagcggcucccccaucguggacaagaaggggaaggucgugggccuguacgggaacggcguggucacccgcagcggcaccuacguguccgcgaucgcccagaccgagaaguccaucgaggacaaccccgagaucgaggacgacaucuuccggaagaagcgccugacgaucauggaccugcacccgggggccggcaagaccaagcgguaccuccccgccaucgugcgcgaggccaucaagcgggggcugcgcacccugauccucgcgcccacccgcgucguggccgccgagauggaggaggcccugcggggccugcccauccgcuaccagacgccggccauccgggcggagcacaccgggcgcgagaucguggaccucaugugccacgccaccuucaccaugcggcugcugagccccguccgcgugcccaacuacaaccucaucaucauggacgaggcccacuucacggaccccgccuccaucgccgcgcggggcuacaucagcacccgcguggagaugggcgaggccgccgggaucuucaugaccgccaccccgcccggcucccgggaccccuucccccagagcaacgcgccgaucauggacgaggagcgcgagauccccgagcgguccuggaacagcgggcacgagugggucacggacuucaagggcaagaccgugugguucgugcccuccaucaaggccgggaacgacaucgccgccugccugcgcaagaacggcaagaaggucauccagcugagccggaagaccuucgacuccgaguacaucaagacccgcacgaacgacugggacuucguggugaccaccgacaucagcgagaugggcgccaacuucaaggcggagcgggucaucgacccccgccggugcaugaagccggugauccucaccgacggggaggagcgcgugauccuggccggccccaugcccgucacgcacuccagcgccgcccagcggcgcgggcgcaucggccggaaccccaagaacgagaacgaccaguacaucuacaugggggagccgcuggagaacgacgaggacugcgcccacuggaaggaggcgaagaugcuccuggacaacaucaacacccccgagggcaucauccccuccauguucgagcccgagcgcgagaagguggacgccaucgacggcgaguaccggcugcgcggggaggcccggaagaccuucguggaccucaugcgccggggcgaccugccggucuggcuggccuaccgcguggccgcggaggggaucaacuacgccgaccggcgcuggugcuucgacggcaucaagaacaaccagauccucgaggagaacgucgagguggagaucuggaccaaggagggggagcggaagaagcugaagccccgcuggcuggacgcccggaucuacagcgacccccucgcccugaaggaguucaaggaguucgcggccggccgcaagucccugacgcucaaccugaucaccgagaugggccggcugccgaccuucaugacccagaaggcccgcaacgcccucgacaaccuggccgugcugcacacggcggaggccgggggccgggccuacaaccacgcccucagcgagcugcccgagacccuggagacccuccugcugcucacccugcuggccacggucaccgggggcaucuuccucuuccugauguccggcaaggggaucggcaagaugacccuggggaugugcugcaucaucaccgcgagcauccuccugugguacgcccagauccagccccacuggaucgccgccuccaucauccuggaguucuuccucaucgugcugcugauccccgagccggagaagcagcgcacgccccaggacaaccagcucacguacguggucaucgccauccugaccgugguggcggccaccauggccaacgagaugggcuuccuggagaagaccaagaaggacuucgggcucggcagcaucgccacgcagcagcccgagagcaacauccuggacaucgaccugcggcccgccuccgcguggacccucuacgccgucgccaccaccuucaucacgccgaugcugcgccacagcaucgagaacuccagcgugaacgugucccugaccgccaucgcgaaccaggccaccguccucaugggccuggggaagggcuggccccugagcaagauggacaucggggugccccuccuggccaucggcugcuacucccaggugaaccccaucacccugacggccgcccuccugcugcucgucgcgcacuacgccaucaucgggccgggccugcaggccaaggccacccgggaggcccagaagcgcgcggccgccggcaucaugaagaaccccaccguggacgggaucaccgugaucgaccuggaccccauccccuacgacccgaaguucgagaagcagcucggccaggucaugcugcuggugcucugcgugacgcagguccugaugaugcgcaccaccugggcccugugcgaggcccucacccuggcgacggggcccaucagcacccugugggagggcaaccccgggcgguucuggaacaccaccaucgccguguccauggccaacaucuuccgcggcagcuaccucgccggcgcggggcugcuguucuccaucaugaagaacacgaccaacacccggcgcggcaccgggaacacgggcgagacccucggcgagaaguggaagaaccggcugaacagccuggggaaguccgaguuccagaucuacaagcgcagcggcauccaggagguggaccggacccucgccaaggaggggaucaagcgcggcgagaccgaccaccacgccgucucccgggggagcgccaagcugcgcugguucguggagcggaaccuggugacgcccgagggcaaggucguggaccucggcugcgggcgcggcgggugguccuacuacugcggcgggcugaagaacgugcgggaggucaagggccugaccaagggcgggccgggccacgaggagcccauccccaugagcaccuacggguggaaccucgugcgccugcaguccggcguggacgucuucuucacgccgcccgagaagugcgacacgcugcucugcgacaucggggagagcagccccaaccccaccguggaggccggccggacccugcgcgugcugaaccucgucgagaacuggcugaacaacaacacccaguucugcaucaaggugcugaaccccuacaugcccuccgugaucgagaagauggagacccugcagcggaaguacggcggggcgcucguccgcaacccccugagccggaacuccacgcacgagauguacugggugagcaacgccuccggcaacaucgugagcuccgucaacaugaucagccgcaugcugaucaaccgcuucaccaugcggcacaagaaggccaccuacgagcccgacguggaccucggguccggcacccgcaacaucgggaucgagagcgagacgccgaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacgugauccccauggucacccagauggcgaugaccgacacgaccccguucgggcagcagcggguguucaaggagaagguggacacccgcacccaggagcccaaggagggcacgaagaagcugaugaagaucaccgccgaguggcuguggaaggagcucggcaagaagaagacgccccggaugugcacccgcgaggaguucgcccggaagguccgcagcaacgccgcccugggggcgaucuucacggacgagaacaaguggaaguccgcccgggaggccguggaggacagccgcuucugggagcuggucgacaaggagcggaaccuccaccuggagggcaagugcgagaccugcguguacaacaugauggggaagcgcgagaagaagaucggcgaguucgggaaggccaagggcucccgggcgaucugguacauguggcugggcgcccgcuuccucgaguucgaggcccugggguuccugaacgaggaccacugguucagccgggagaacagccucuccggcguggagggggagggccugcacaagcugggguacauccuccgcgaggucagcaagaaggagggcggcgccauguacgccgacgacaccgcggggugggacacccggaucacgcuggaggaccugaagaacgaggagauggugaccaaccacauggagggcgagcacaagaagcucgccgaggccaucuucaagcugaccuaccagaacaaggugguccgcgugcagcggcccaccccgcgcgggacggugauggacaucaucucccgccgggaccagcgcggcagcgggcaggucggcaccuacggccugaacaccuucaccaacaugggggcccagcucauccggcagauggagggcgaggggguguucaagggcauccagcaccugacggccaccgaggagguggcgguccaggacuggcuggcccgcgugggccgggagcgccucucccggauggccaucagcggggacgacugcguggucaagccccuggacgaccgcuucgccaacgcccugaccgcgcucaacgacaugggcaaggugcggaaggacauccagcagugggagcccucccgcggguggaacgacuggacccaggugcccuucugcagccaccacuuccacgagcugaucaugaaggacggccggguccugguggugccgugccgcaaccaggacgagcucaucgggcgggcccgcaucucccagggcgccggcuggagccugcgggagacggccugccuggggaaguccuacgcccagauguggagccucauguacuuccaccgccgggaccugcgccuggcggccaacgccaucugcuccgccguccccagccacugggugcccaccucccggaccaccuggagcauccacgcgcgccacgaguggaugaccacggaggacaugcucaccguguggaaccgcgucuggauccaggagaaccccuggauggaggacaagaccccgguggaguccugggaggagauccccuaccugggcaagcgggaggaccaguggugcgggagccugaucggccucaccagccgcgccacgugggcccggaacauccagaccgccaucaaccaggugcgcucccugaucgggagcgaggaguacaccgacuacaugcccuccaugaagcgguuccgccgggaggaggaggaggccggcguccugugguga

SEQ ID NO: 9319 - RNA, 9876 nt, Artificial Sequence
  derived and/or modified CDS sequence (opt1) from DENV-2__KF955364__SS-prME
accgccggggugaucaucaugcugauccccaccgccauggcguuccaccucaccacccggaacggggagccgcacaugaucgucgggcggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacggcgugaagcugaccaucaugaccggggacaucaagggcaucaugcaggccggcaagcggucccugcgcccgcagcccaccgagcucaaguacagcuggaagacgugggggaaggccaagaugcuguccaccgagagccacaaccagaccuuccugaucgacggccccgagaccgcggagugcccgaacacgaaccgggccuggaacucccucgaggucgaggacuacggguucggcguguucagcaccaacaucuggcugaagcugcgcgagaagcaggacgugcucugcgacuccaagcugaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccucugguccaacggggugcuggagagcgagaugaucauccccaagaacuucgccggccccgugucccagcacaacuaccgcccgggguaccacacccagacggccggccccuggcaccuggggaagcucgagauggacuucgacuucugcgagggcaccaccgucguggugaccgaggacugcggcaaccgggggcccagccugcgcacgaccaccgcgagcggcaagcugaucaccgaguggugcugccgguccugcacgcucccgccccugcgcuaccgcggggaggacggcugcugguacgggauggagauccgcccccugaaggagaaggaggagaaccucgucaacagccuggugaccgccggccacggccagaucgacaacuucucccugggggugcucggcauggcccuguuccuggaggagaugcuccggacccgcgucgggaccaaguacgccauccugcugguggcggugagcuucgucacgcucaucaccggcaacauguccuuccgggaccuggggcgcgugauggugauggucggcgccaccaugaccgacgacaucggcaugggggugacguaccuggcccuccuggccgccuucaaggugcgccccaccuucgcggccggccugcuccugcggaagcugaccagcaaggagcucaugauggccaccaucgggaucgcccugcugucccagagcacgauccccgagaccauccucgagcugaccgacgcccuggcgcucggcaugaugguccugaagaucgugcgcaacauggagaaguaccagcuggccgugaccaucauggccaucuccugcguccccaacgccgugauccuccagaacgccuggaaggugagcugcacgauccuggcggccgucuccgugagcccccugcuccugaccuccagccagcagaaggccgacuggaucccccuggcccucaccaucaagggccugaaccccaccgcgaucuuccugacgacccucucccggaccagcaagaagcgcuccuggccgcugaacgaggccgucauggccguggggauggugagcauccuggccuccagccuccugaagaacgacauccccaugaccggcccccuggucgccgggggccuccugacggugugcuacgugcugaccgggcggagcgcggaccucgagcuggagcgcgccgccgacgucaagugggaggaccaggccgagaucuccggcagcucccccauccugagcaucaccaucuccgaggacggcagcauguccaucaagaacgaggaggaggagcacacccucacgauccugauccggaccgggcugcucgugaucagcggcguguucccggucuccauccccaucaccgccgcggccugguaccugugggaggugaagaagcagcgcgccggggugcugugggacguccccuccccgccgcccgugggcaaggccgagcucgaggacggggccuaccggaucaagcagcgcggcaucuucggcuacucccagaucggggcgggcguguacaaggaggggaccuuccacaccauguggcacgucacgcggggcgccgugcugaugcaccgcgggaagcggaucgagcccagcugggccgacgugaagaaggaccugaucuccuacggcggcggguggaagcucgagggcgaguggaaggagggggaggagguccaggugcuggcccuggagcccggcaagaacccccgcgccgugcagaccaagcccggccucuucaagaccaacaccggcacgaucggcgcggucagccuggacuucucccccgggaccagcggcucccccaucguggaccggaaggggaagguggucggccuguacggcaacgggguggugacccgcagcggcgccuacgucuccgccaucgcccagaccgagaaguccaucgaggacaaccccgagaucgaggacgacaucuuccggaagaagcgccucacgaucauggaccugcaccccggggcgggcaagaccaagcgguaccugcccgccaucgugcgcgaggccaucaagcgggggcugcgcacccucauccuggccccgacccgcguggucgccgcggagauggaggaggcccugcggggccuccccauccgcuaccagacgcccgccauccgggccgagcacaccggccgcgagaucguggaccugaugugccacgccaccuucaccaugcggcugcucagccccgugcgcgucccgaacuacaaccugaucaucauggacgaggcgcacuucacggaccccgccuccaucgccgcccggggguacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugacggacuucaagggcaagaccgucugguucgugccguccaucaaggccggcaacgacaucgcggccugccugcgcaagaacgggaagaaggugauccagcucagccggaagaccuucgacuccgaguacgucaagacccgcgccaacgacugggacuucguggugacgaccgacaucagcgagaugggcgccaacuuccgggccgagcgcgucaucgacccccggcgcugcaugaagcccgugauccugaccgacggggaggagcgggugauccuggcgggccccaugccggucacccacuccagcgccgcccagcgccgcgggcggaucggccgcaaccccaagaacgagaacgaccaguacaucuacaugggcgagccccucgagaacgacgaggacugcgcccacuggaaggaggccaagaugcugcuggacaacaucaacacgcccgaggggaucaucccguccauguucgagcccgagcgggagaagguggacgcgaucgacggcgaguaccgccuccgcggggaggcccgcaagaccuucguggaccugaugcggcgcggcgaccugcccgucuggcucgccuaccggguggccgccgaggggaucaacuacgcggaccgccgguggugcuucgacggcaucaagaacaaccagauccuggaggagaacguggaggucgagaucuggaccaaggagggcgagcgcaagaagcugaagccgcgguggcucgacgcccgcaucuacagcgacccccuggcccugaaggaguucaaggaguucgccgcggggcggaagucccucacccugaaccugaucacggagaugggccgccuccccaccuucaugacccagaaggcccgggacgcccuggacaaccuggccgugcuccacaccgccgaggucgggggccgcgcguacaaccacgcccugagcgagcugcccgagacgcucgagacccugcugcuccugacccugcucgccaccgugacgggcgggaucuuccuguuccugauguccggcaaggggaucggcaagaugacccucgggaugugcugcaucaucaccgccagcauccugcugugguacgcccagauccagccgcacuggaucgcggccuccaucauccucgaguucuuccugaucgugcugcucauccccgagcccgagaagcagcggacgccccaggacaaccagcugaccuacgucgugaucgccauccugacgguggucgccgccaccauggcgaacgagaugggcuuccucgagaagaccaagaaggaccugggccuggggagcaucaccacgcaggagagcgaguccaacauccucgacaucgaccugcgcccggccagcgccuggacccuguacgccguggccaccaccuucgugacgcccaugcuccggcacuccaucgagaacagcuccgucaacgugagccugaccgcgaucgccaaccaggccaccgugcugaugggccucgggcgcggcuggccccuguccaagauggacaucggggucccccugcucgccaucggcugcuacagccaggugaacccgaucacccugacggcggcccugcuccugcugguggcccacuacgccaucaucggccccgggcuccaggccaaggcgacccgcgaggcccagaagcggaccgccgccggcaucaugaagaaccccaccgucgacgggaucacggugaucgaccuggagcccaucccguacgaccccaaguucgagaagcagcugggccaggugaugcuccugguccugugcgugacccaggugcucaugaugcgcaccaccugggcccugugcgaggcgcugacgcucgccaccgggcccaucuccacccugugggagggcaaccccggccgguucuggaacaccacgaucgccgucagcauggccaacaucuuccgcggguccuaccuggccggcgcggggcuccuguucagcaucaugaagaacaccaccaacacccggcgcggcacgggcaacaucggggagacccugggcgagaaguggaagucccggcucaacgcccugggcaagagcgaguuccagaucuacaagaaguccggcauccaggagguggaccgcacccuggccaaggaggggaucaagcggggcgagaccgaccaccacgccgugagccgcggcuccgcgaagcuccggugguucgucgagcgcaacauggugacgccggaggggaagguggucgaccugggcugcgggcggggcggguggagcuacuacugcggcggccugaagaacgugcgcgaggugaaggggcucaccaagggcgggcccggccacgaggagcccauccccauguccaccuacggguggaaccugguccggcugcagagcggcguggacguguucuucaccccgcccgagaagugcgacacgcuccugugcgacaucggcgagagcucccccaaccccaccaucgaggccgggcgcacccugcggguccucaaccugguggagaacuggcugaacaacaacacccaguucugcgugaagguccucaacccguacaugcccagcgugaucgagaagauggagacccugcagcgcaaguacggcggggcccuggugcggaacccccugucccgcaacagcacgcacgagauguacugggucuccaacgccaccggcaacaucgugagcuccgugaacaugaucagccgcaugcucaucaaccgguucaccaugaagcacaagaaggccaccuacgagccggacgucgaccugggguccggcacgcgcaacaucggcaucgagaacgagauccccaaccuggacaucaucgggaagcggaucgagaagaucaagcaggagcacgagaccagcuggcacuacgaccaggaccaccccuacaagaccugggcguaccacggcuccuacgagaccaagcagacggggagcgccuccagcauggugaacggcguggucaagcuccugaccaagcccugggacguggugccgauggucacccagauggccaugaccgacacgacccccuucggccagcagcgcguguucaaggagaagguggacacccggacccaggagcccaaggaggggacgaagaagcugaugcgcaucaccgccgaguggcucuggaaggagcugggcaagaagaagacgccccggaugugcacccgcgaggaguucacgcggaagguccgcuccaacgccgcgcugggggccaucuucaccgacgagaacaaguggaaguccgcccgggaggccguggaggacucccgcuucugggagcucgucgaccgggagcgcaaccugcaccuggagggcaagugcgagaccugcguguacaacaugauggggaagcgggagaagaagcucggcgaguucggcaaggccaaggggagccgcgcgaucugguacauguggcugggcgcccgguuccuggaguucgaggcccucggguuccugaacgaggaccacugguucucccgcggcaacagccugagcgggguggagggcgagggccuccacaagcugggguacauccugcgggacgucuccaagaaggagggcggggccauguacgcggacgacaccgccggcugggacacgcgcaucacccucgaggaccugaagaacgaggagauggugaccaaccacaugaagggggagcacaagaagcuggccgaggccaucuucaagcucaccuaccagaacaaggugguccgggugcagcgcccgacgccccgcggcaccgugauggacaucaucagccggaaggaccagcgcggcuccgggcaggucggcaccuacgggcugaacaccuucacgaacauggaggcccagcugauccggcagauggagggcgagggcaucuucaagagcauccagcgccucaccgugaccgaggagaucgcggugcagaacuggcuggcccgggucgggcgcgagcggcugucccgcauggccaucagcggcgacgacugcguggugaagccccucgacgaccgguucgccuccgcccugaccgcgcugaacgacauggggaagguccgcaaggacauccagcagugggagcccagccggggcuggaacgacuggacccaggugccguucugcucccaccacuuccacgagcucgugaugaaggacgggcgcguccugguggugcccugccggaaccaggacgagcugaucggccgcgcccggaucagccagggcgccggguggucccucaaggagaccgccugccugggcaagagcuacgcccagauguggacccugauguacuuccaccgccgggaccuccgccuggcggccaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccucgggaagcgcgaggaccaguggugcggcagccugaucgggcugacgagccgggccaccugggccaagaacauccagaccgccaucaaccagguccgcucccucaucggcaacgaggaguacaccgacuacaugcccagcaugaagcgguuccgcaaggaggaggaggaggcgggcgugcugugguga

SEQ ID NO: 9320 - RNA, 9876 nt, Artificial Sequence
  derived and/or modified CDS sequence (opt1) from DENV-2__KF955372__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggaguacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacguggaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcuccgggaucuucaucaccgacaacgugcacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgagguggaggacuacggcuucgggguguucuccacgaacaucuggcugaagcugcgcgagaagcaggacgucuucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgucacggccgggcacggccagaucgacaacuucagccugggcgugcuggggauggcccucuuccuggaggagaugcugcggacccgcgugggcaccaagcacgccauccuccuggucgcgguguccuucgugacccugaucacggggaacaugagcuuccgggaccucggccgcgucauggugauggugggggccaccaugaccgacgacaucggcaugggcgucaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucguccgcaacauggagaaguaccagcuggccgugaccaucauggccaucagcugcgugccgaacgccgucauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgucggcaugguguccauccuggccagcagccugcucaagaacgacauccccaugaccgggccccugguggccggcgggcugcucaccgucugcuacgugcugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggucaucuccgggguguucccggugagcauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacagccagaucggcgcggggguguacaaggagggcaccuuccacaccauguggcacgugacccgcggggccguccucaugcaccgcggcaagcggaucgagcccuccugggccgacgugaagaaggaccugaucagcuacgggggcggcuggaagcuggagggggaguggaaggagggcgaggaggugcagguccucgcccuggagcccgggaagaacccccgcgccgugcagacgaagcccggccuguucaagaccaacaccgggaccaucggcgcggugucccucgacuucagccccggcacguccgggagccccaucgucgaccggaagggcaaggugguggggcuguacggcaacggcgucgugacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucguccgcgaggccaucaagcggggccugcgcacccugauccucgccccgacccgcgugguggccgcggagauggaggaggcccugcgggggcugcccauccgcuaccagacccccgccauccgggccgagcacacgggccgcgagaucgucgaccucaugugccacgccaccuucaccaugcggcugcugucccccgugcgcgugccgaacuacaaccucaucaucauggacgaggcgcacuucaccgaccccgccagcacggccgcccggggcuacaucuccacccgcgucgagaugggggaggccgcgggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgugugguucgucccgagcaucaaggccggcaacgacaucgcggccugccugcgcaagaacggcaagaaggugauccagcugucccggaagaccuucgacagcgaguacgugaagacccgcgccaacgacugggacuucgucgugacgaccgacaucuccgagaugggggccaacuuccgggccgagcgcgugaucgacccccggcgcugcaugaagcccgucauccucaccgacggcgaggagcgggugauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggugggcgggcgcgcguacaaccacgcccucuccgagcugcccgagacgcuggagacccuccugcugcucacccugcuggccaccgucacgggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacguggucaucgccauccugacggugguggccgccaccauggcgaacgagaugggguuccuggagaagaccaagaaggaccucggccugggcagcaucaccacgcaggaguccgagagcaacauccuggacaucgaccuccgcccggccuccgccuggacccuguacgccgucgccaccaccuucgugacgcccaugcugcggcacagcaucgagaacuccagcgugaacgucucccucaccgcgaucgccaaccaggccaccgugcugauggggcugggccgcggguggccccucagcaagauggacaucggcgugccccugcuggccaucgggugcuacucccaggucaacccgaucacccucacggcggcccugcugcuccugguggcccacuacgccaucaucggccccggccugcaggccaaggcgacccgcgaggcccagaagcgggccgccgccgggaucaugaagaaccccaccguggacggcaucaccgucaucgaccucgagcccaucccguacgaccccaaguucgagaagcagcugggccaggugaugcugcucgugcugugcgucacccaggugcugaugaugcgcaccaccugggcgcucugcgaggcccugacccuggccacgggccccaucagcacccucugggaggggaaccccggccgguucuggaacaccaccaucgccguguccauggccaacaucuuccgcggcagcuaccuggcgggggccggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggaggucgaccgcacccuggccaaggagggcaucaagcgcggggagaccgaccaccacgcggugucccgcggcagcgccaagcugcggugguucguggagcgcaacauggucaccccggagggcaaggugguggaccucgggugcggccgcggcgggugguccuacuacugcggcgggcugaagaacguccgcgaggugaaggggcugacgaagggcgggcccgggcacgaggagcccauccccaugagcaccuacggcuggaaccucgugcggcugcagagcggggucgacguguucuucaccccgcccgagaagugcgacacccugcucugcgacaucggcgaguccagccccaaccccacgaucgaggccggccgcacccugcgggugcugaaccucgucgagaacuggcugaacaacaacacccaguucugcaucaaggugcugaacccguacaugcccuccgugaucgagaagauggagacccuccagcgcaaguacgggggcgcccugguccggaacccccugagccgcaacuccacccacgagauguacugggugagcaacgccacggggaacaucguguccagcgucaacaugaucucccgcaugcugaucaaccgguucaccaugaagcacaagaaggcgaccuacgagccggacguggaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggucgugcgccugcucacgaagcccugggacguggucccgauggugacccagauggccaugaccgacaccacgcccuucggccagcagcggguguucaaggagaaggucgacacccgcacccaggagcccaaggagggcaccaagaagcugaugcggaucacggccgaguggcuguggaaggagcucgggaagaagaagacgccccggaugugcacccgggaggaguucacccgcaaggugcggagcaacgcggcccugggcgccaucuucacggacgagaacaaguggaaguccgcccgcgaggccgucgaggacagccgguucugggagcugguggaccgcgagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcgucgagggggagggccugcacaagcucggcuacauccugcgcgacgugagcaagaaggagggcggggcgauguacgccgacgacaccgccgggugggacacccggaucacgcuggaggaccucaagaacgaggagauggugaccaaccacaugaagggcgagcacaagaagcuggccgaggccaucuucaagcugaccuaccagaacaaggucgugcgcgugcagcgcccgacgccccgggggacggucauggacaucaucucccgcaaggaccagcggggcagcggccagguggggaccuacggccucaacaccuucaccaacauggaggcgcagcugauccgccagauggagggggagggcaucuucaaguccauccagcggcugacggugaccgaggagaucgccguccagaacuggcucgcccgcgugggccgggagcgccugagccggauggccaucuccggggacgacugcguggucaagccccuggacgaccgcuucgccagcgcgcucaccgcccugaacgacaugggcaaggugcggaaggacauccagcagugggagcccucccgcggguggaacgacuggacccaggugccguucugcagccaccacuuccacgagcuggucaugaaggacggccgggugcucgugguccccugccgcaaccaggacgagcugaucgggcgggcccgcaucucccagggcgccggcuggagccugaaggagacggccugccucgggaaguccuacgcgcagauguggacccugauguacuuccaccggcgcgaccugcggcucgccgccaacgccaucugcagcgccgugcccucccacugggugcccaccagccgcaccaccugguccauccacgcgaagcacgaguggaugacgaccgaggacaugcuggccgucuggaaccgcguguggauccaggagaacccguggauggaggacaagacccccguggagagcugggaggagguccccuaccugggcaagcgggaggaccaguggugcgggagccucaucggccugaccucccgcgccacgugggccaagaacauccagaccgcgaucaaccaggugcggagccugaucgggaacgaggaguacaccgacuacaugcccuccaugaagcgcuuccggaaggaggaggaggaggccggcgugcucugguga

SEQ ID NO: 9321 - RNA, 9876 nt, Artificial Sequence
  derived and/or modified CDS sequence (opt1) from DENV-2__KF955373__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccgcucagcauccccaucaccgccgcggccugguaccugugggaggugaagaagcagcgcgccggcgugcugugggacguccccagcccgccgcccguggggaaggccgagcucgaggacggcgccuaccggaucaagcagcgcgggaucuucggcuacagccagaucggcgcggggguguacaaggagggcaccuuccacaccauguggcacgucacccgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgccgugcagacgaagcccggccucuucaagaccaacaccgggaccaucggcgcggucucccuggacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcguggucgccgcggagauggaggaggcccugcgggggcuccccauccgcuaccagacccccgccauccgggccgagcacacgggccgcgagaucguggaccugaugugccacgccaccuucaccaugcggcugcucucccccgugcgcgucccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcucucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccugaccgacggcgaggagcgggugauccuggcggggcccaugccggucacccacagcuccgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgggagaagguggacgcgaucgacggggaguaccgccuccggggcgaggcccgcaagacguucguggaccugaugcggcgcggggaccugcccgucuggcucgccuaccggguggccgccgagggcaucaacuacgcggaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcccugaaggaguucaaggaguucgccgcgggccggaagucccucacccugaaccugaucaccgagauggggcgccuccccacguucaugacccagaaggcccgggacgcccuggacaaccuggccgugcuccacaccgccgaggucggcgggcgcgcguacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcccagauccagccgcacuggaucgcggccagcaucauccucgaguucuuccugaucgugcugcucauccccgagcccgagaagcagcggacgccccaggacaaccagcugaccuacgucgugaucgccauccugaccguggucgccgccacgauggcgaacgagaugggguuccucgagaagaccaagaaggaccugggccugggcagcaucaccacccaggaguccgagagcaacauccucgacaucgaccugcgcccggccuccgccuggacgcuguacgccguggccaccaccuucgugacccccaugcuccggcacagcaucgagaacuccagcgucaacgugucccugacggcgaucgccaaccaggccaccgugcugauggggcucggccgcggguggccccugagcaagauggacaucggcgucccccugcucgccaucgggugcuacucccaggugaacccgaucacccugaccgcggcccugcuccugcugguggcccacuacgccaucaucggccccggccuccaggccaaggcgacgcgcgaggcccagaagcgggccgccgccgggaucaugaagaaccccaccgucgacggcaucaccgugaucgaccuggagcccaucccguacgaccccaaguucgagaagcagcugggccaggugaugcuccugguccugugcgugacccaggugcucaugaugcgcacgaccugggcgcugugcgaggcccugacccucgccaccggccccaucagcacgcugugggaggggaaccccggccgguucuggaacaccaccaucgccgucuccauggccaacaucuuccgcggcagcuaccuggcgggggccggccuccuguucuccaucaugaagaacaccacgaacacccggcgcgggaccggcaacaucggcgagacccugggggagaaguggaagucccggcucaacgcccugggcaaguccgaguuccagaucuacaagaaguccgggauccaggagguggaccgcacgcuggccaaggagggcaucaagcgcggggagaccgaccaccacgcggugucccgcggcagcgccaagcuccggugguucgucgagcgcaacauggugaccccggagggcaagguggucgaccuggggugcggccgcggcgggugguccuacuacugcggcgggcugaagaacgugcgcgaggugaaggggcucaccaagggcgggcccgggcacgaggagcccauccccaugagcacguacggcuggaaccugguccggcugcagagcgggguggacguguucuucaccccgcccgagaagugcgacacccuccugugcgacaucggcgaguccagccccaaccccaccaucgaggccggccgcacgcugcggguccucaaccugguggagaacuggcugaacaacaacacccaguucugcaucaaggugcucaacccguacaugcccuccgucaucgagaagauggagacccugcagcgcaaguacgggggcgcccuggugcggaacccccugagccgcaacuccacccacgagauguacugggugagcaacgccaccgggaacaucgucuccagcgugaacaugaucucccgcaugcucaucaaccgguucacgaugaagcacaagaaggcgaccuacgagccggacguggaccugggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggucaacgggguggugaagcuccugaccaagcccugggacgucgugccgauggugacgcagauggccaugaccgacaccacccccuucggccagcagcgcgucuucaaggagaagguggacacgcggacccaggagcccaaggagggcaccaagaagcugaugcgcaucaccgccgaguggcucuggaaggagcuggggaagaagaagacgccccggaugugcacccgcgaggaguucacccggaaggugcgcagcaacgcggcccugggcgccaucuucaccgacgagaacaaguggaaguccgcccgggaggccgucgaggacagccgcuucugggagcucguggaccgggagcgcaaccugcaccuggaggggaagugcgagacgugcgucuacaacaugaugggcaagcgggagaagaagcucggggaguucggcaaggcgaagggcucccgcgccaucugguacauguggcugggggcccgguuccuggaguucgaggcccucggcuuccugaacgaggaccacugguucagccgcgggaacagccuguccggcguggagggggagggccuccacaagcugggcuacauccugcgggacgugagcaagaaggagggcggggcgauguacgccgacgacaccgccgggugggacacccgcaucacccucgaggaccugaagaacgaggagauggucacgaaccacaugaagggcgagcacaagaagcuggccgaggccaucuucaagcucaccuaccagaacaagguggugcggguccagcgcccgacgccccgggggaccgugauggacaucaucucccggaaggaccagcgcggcagcggccagguggggacguacggccugaacaccuucaccaacauggaggcgcagcugauccggcagauggagggggagggcaucuucaaguccauccagcgccucaccgucacggaggagaucgccgugcagaacuggcuggcccgggugggccgcgagcggcugagccgcauggccaucuccggggacgacugcgucgugaagccccucgacgaccgguucgccagcgcgcugaccgcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucgggcgcgcccggaucucccagggcgccggcuggagccucaaggagaccgccugccuggggaaguccuacgcgcagauguggacgcugauguacuuccaccgccgggaccuccgccuggccgccaacgccaucugcagcgccgugcccucccacuggguccccaccagccggaccaccugguccauccacgcgaagcacgaguggaugaccacggaggacaugcuggccguguggaaccgcguguggauccaggagaacccguggauggaggacaagacccccgucgagagcugggaggaggugcccuaccucggcaagcgcgaggaccaguggugcgggagccugaucggccugaccucccgggccaccugggccaagaacauccagacggcgaucaaccaggugcgcagccucaucgggaacgaggaguacaccgacuacaugcccuccaugaagcgguuccgcaaggaggaggaggaggccggcguccugugguga

SEQ ID NO: 9322 - RNA, 9876 nt, Artificial Sequence
  derived and/or modified CDS sequence (opt1) from DENV-2__GQ868600__SS-prME
accgcgggcaugaucaucaugcugauccccaccgugauggccuuccaccucaccacccgcaacggggagccccacaugaucgugagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccacgaccggcgagcaccgccgggagaagcgcagcguggcccuggucccccacgugggcauggggcuggagacccggaccgagacguggauguccagcgagggcgccuggaagcacgcccagcgcaucgagaccuggauccuccggcaccccggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugcccgacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggguguucacguccaucggcaaggcccugcaccaggucuucggggccaucuacggcgcggccuucagcggcguguccuggaccaugaagauccucaucggggugaucaucaccuggaucggcaugaacagccgguccaccagccuguccgucagccuggugcugguggggaucgucacgcucuaccugggcgugauggugcaggccgacuccgggugcgucgugagcuggaagaacaaggagcugaagugcggcuccggcaucuucgugaccgacaacguccacaccuggaccgagcaguacaaguuccagcccgagagccccagcaagcucgccuccgcgauccagaaggcccacgaggaggggaucugcggcauccgcagcgugacgcggcuggagaaccugauguggaagcagaucaccuccgagcucaaccacauccugagcgagaacgaggugaagcugaccaucaugaccggggacaucaagggcaucaugcaggucgggaagcgcucccuccggccccagccgacggagcugcgcuacagcuggaagaccuggggcaaggccaagaugcuguccaccgagcuccacaaccagaccuuccugaucgacggccccgagacggccgagugccccaacaccaaccgggccuggaacagccuggagguggaggacuacggguucggcguguucaccaccaacaucuggcuccgccugcgggagaagcaggacgcguucugcgacuccaagcugaugagcgccgccaucaaggacaaccgcgccguccacgccgacaugggguacuggaucgaguccgcgcucaacgacaccuggaagaucgagaaggccagcuucaucgaggugaaguccugccacuggcccaagucccacacgcugugguccaacggcgugcuggagagcgagauggucauccccaagaacuucgccggccccgugucccagcacaacaaccggcccggguaccacacccagaccgccggcccguggcaccucgggaagcuggagauggacuucgacuucugcgagggcaccacgguggucgugaccgaggacugcgggaaccgcggccccagccugcggaccaccacggccagcggcaagcucaucaccgaguggugcugccgcuccugcacccugccgccccugcgguaccgcggggaggacggcugcugguacgggauggagauccggccgcucaaggagaaggaggagaaccuggugagcucccuggucaccgcgggccacgggcagaucgacaacuucagccucggcauccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgcgacgaugaccgacgacaucgggaugggcgugaccuaccucgcccugcuggccgccuucaagguccggcccaccuucgccgcgggccuccugcugcgcaagcucacguccaaggagcugaugaugaccaccaucgggaucgugcugcucagccaguccagcauccccgagaccauccuggagcugacggacgcccucgcccugggcaugauggugcugaagaugguccggaacauggagaaguaccagcucgccgugaccaucauggccauccugugcgugcccaacgcggucauccugcagaacgccuggaagguguccugcaccauccucgccgucgugagcguguccccgcugcugcucaccagcucccagcagaaggccgacuggaucccccuggcccugacgaucaaggggcucaaccccaccgcgaucuuccugaccacccugagccgcacguccaagaagcggagcuggccccucaacgaggccaucauggccgucggcaugguguccauccuggccagcagccugcucaagaacgacaucccgaugaccggcccccugguggccggcgggcugcucaccgucugcuacgugcugaccgggcgcuccgccgaccuggagcucgagcgggccacggacgugaagugggacgaccaggccgagaucagcggguccagccccauccuguccaucaccaucagcgaggacggguccaugagcaucaagaacgaggaggaggagcagacccugaccauccucauccgcaccggccugcuggucaucuccggccucuuccccgugagcaucccgaucacggccgcggccugguaccugugggaggugaagaagcagcgggccgggguccugugggacgugcccagcccgccgcccgugggcaaggccgagcucgaggacggggccuaccgcaucaagcagaagggcauccugggguacagccagaucggcgcgggcgucuacaaggaggggaccuuccacaccauguggcacgugacccggggcgccgugcugaugcacaaggggaagcgcaucgagcccuccugggccgacgucaagaaggaccucaucagcuacggcgggggcuggaagcuggagggcgaguggaaggagggggaggagguccaggugcuggcccucgagcccggcaagaacccccgggccguccagacgaagcccgggcuguuccgcaccaacaccggcaccaucggggcggugucccuggacuucagccccggcacguccggcagccccaucguggacaagaaggggaaggucgugggccucuacgggaacggcguggucacccgguccggcgccuacgugagcgccaucgcccagaccgagaaguccaucgaggacaacccggagaucgaggacgacaucuuccgcaagcggcgccugaccaucauggaccugcaccccggggccggcaagacgaagcgguaccugcccgcgaucgugcgcgaggccaucaagcgggggcuccgcacccugauccuggcccccacccgcgucguggccgcggagauggaggaggcccuccggggccugccgauccgcuaccagacccccgccauccgggccgagcacacggggcgcgagaucguggaccugaugugccacgccaccuucaccaugcggcuccugagccccauccgcguccccaacuacaaccugaucaucauggacgaggcgcacuucaccgacccggccagcaucgccgcccggggcuacaucuccacgcgcguggagaugggcgaggccgcggggaucuucaugaccgccacgccgcccggcagccgggaccccuucccgcaguccaacgcccccaucauggacgaggagcgcgagauccccgagcggagcuggaacuccgggcacgagugggugaccgacuucaagggcaagacggucugguucgugcccagcaucaagaccgggaacgacaucgccgccugccuccgcaagaacggcaagcgggugauccagcugucccgcaagaccuucgacagcgaguacgucaagacccggacgaacgacugggacuucguggugaccaccgacaucuccgagaugggcgcgaacuucaaggccgagcgcgucaucgacccgcggcgcugcaugaagcccgugauccugaccgacggggaggagcgggugauccucgccggccccaugcccgucacgcacagcuccgccgcgcagcgccgcgggcggaucggccgcaacccgcggaacgagaacgaccaguacaucuacaugggggagccccuggagaacgacgaggacugcgcccacuggaaggaggccaagaugcugcucgacaacaucaacacccccgagggcaucauccccagcauguucgagccggagcgcgagaagguggacgccaucgacggcgaguaccggcugcgcggggaggcccggaagaccuucguggaccugaugcgccggggcgaccuccccgucuggcuggcguacaagguggccgccgaggggaucaacuacgccgaccgccgguggugcuucgacggcacccgcaacaaccagauccuggaggagaacguggaggucgagaucuggacgaaggagggggagcggaagaagcucaagccccgcuggcuggacgcccggaucuacuccgacccgcuggcgcucaaggaguucaaggaguucgccgccggccgcaagagccugacccugaaccucaucaccgagaugggccggcugcccaccuucaugacgcagaaggcccgcgacgcccuggacaaccucgcggugcugcacaccgccgaggccgggggcaaggccuacaaccacgcgcuguccgagcuccccgagacccuggagacccugcuccugcugacccuccuggccacggucaccgggggcaucuuccuguuccucaugagcggccgggggaucggcaagaugacccuggggaugugcugcaucaucaccgccuccauccugcucugguacgcccagauccagccccacuggaucgccgcgagcaucauccuggaguucuuccugaucgugcuccugaucccggagcccgagaagcagcgcacgccccaggacaaccagcugaccuacgugaucaucgccauccucaccgucguggccgccaccauggccaacgagaugggcuuccuggagaagacgaagaaggaccuggggcucggcaacaucgcgacccagcagcccgagagcaacauccuggacaucgaccugcggccggccuccgccuggacccucuacgccguggccaccacguucaucacccccaugcugcgccacagcaucgagaacuccagcgucaacgugucccugaccgcgaucgccaaccaggccaccgugcucaugggccuggggaagggcuggccccugagcaagauggacaucggggucccccuccuggccaucggcugcuacucccaggugaacccgaucacgcugaccgccgcgcuccugcugcucguggcccacuacgccaucaucgggcccggccugcaggccaaggcgacccgcgaggcccagaagcgggccgccgccggcaucaugaagaaccccaccgucgacgggaucacggugaucgaccuggaccccaucccguacgaccccaaguucgagaagcagcucggccaggugaugcugcugguccucugcgugacccaggugcugaugaugcgcaccaccugggcgcugugcgaggcccucacgcuggccaccgggcccgucagcacccugugggagggcaaccccgggcgguucuggaacaccacgaucgccguguccauggccaacaucuuccgcggcagcuaccucgcgggcgccgggcugcuguucuccaucaugaagaacaccaccagcacccggcgcggcacggggaacaucggcgagacccucggcgagaaguggaagucccggcugaacgcccuggggaaguccgaguuccagaucuacaagaaguccggcauccaggagguggaccgcacccucgccaaggaggggaucaagcggggcgagaccgaccaccacgccgucagccgcggguccgcgaagcugcggugguucguggagcgcaaccuggugacgccggagggcaaggucguggaccucggcugcgggcggggcggguggagcuacuacugcggcgggcugaagaacgugcgcgaggucaagggccugaccaagggcgggcccggccacgaggagcccauccccauguccaccuacggguggaaccucgugcggcugcagagcggcguggacgucuucuucgugccgcccgagaagugcgacacccugcucugcgacaucggggagagcucccccaaccccaccguggaggccggccgcacgcugcggguccugaaccucguggagaacuggcugaacaacaacacccaguucugcgugaagguccugaacccguacaugcccagcgugaucgagcgcauggagacccugcagcggaaguacggcggggcccucgugcgcaacccccugucccgcaacagcacccacgagauguacugggucuccaacgccagcggcaacaucguguccagcgugaacaugaucucccggaugcugaucaaccgcuucacgaugcggcacaagaaggcgaccuacgagccggacgucgaccucgggagcggcacccgcaacaucgggaucgaguccgagacccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccugcucacgaagcccugggacguggugccgauggucacccagauggccaugaccgacaccacgcccuucgggcagcagcggguguucaaggagaagguggacacccgcacccaggagcccaaggagggcaccaagaagcugaugaagaucacggccgaguggcuguggaaggagcucggcaagaagaagacgccccggaugugcacccgcgaggaguucaccaagaagguccgguccaacgcggcccugggggccaucuucacggacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggcgaagggcagccgcgccaucugguacauguggcucggcgcccgguuccuggaguucgaggcccugggguuccucaacgaggaccacugguucagccgcgagaacucccugagcggcguggagggggagggccugcacaagcucggguacauccugcgggaggucuccaagaaggagggcggcgccauguacgcggacgacaccgccgggugggacacccgcaucacgaucgaggaccugaagaacgaggagaugaucaccaaccacauggccggcgagcacaagaagcucgccgaggcgaucuucaagcugaccuaccagaacaagguggugcggguccagcgcccgacgccccgcgggaccgugauggacaucaucagccggcgcgaccagcggggcuccggccaggugggcaccuacggccugaacaccuucaccaacauggaggcccagcucauccgccagauggagggggagggcaucuucaagagcauccagcaccugacggccuccgaggagaucgccguccaggacuggcuggugcggguggggcgcgagcggcucagccgcauggccaucuccggcgacgacugcgucgugaagccccuggacgaccgguucgcgcgcgcccugaccgcccucaacgacaugggcaaggugcggaaggacauccagcagugggagcccagccgcggguggaacgacuggacccaggucccguucugcucccaccacuuccacgagcugaucaugaaggacggccggacccugguggugcccugccgcaaccaggacgagcucaucgggcgggcccgcaucagccagggcgccggguggucccugcgggagaccgcgugccugggcaagagcuacgcccagauguggucccucauguacuuccaccgccgggaccugcgccuggccgccaacgccaucugcagcgcgguccccucccacugggugcccacgagccgcaccaccuggagcauccacgccucccacgaguggaugaccacggaggacaugcucaccguguggaacaaggucuggauccuggagaacccguggauggaggacaagacccccguggagagcugggaggagauccccuaccugggcaagcgggaggaccaguggugcgggucccucaucggccugaccagccgcgccacgugggccaagaacauccagaccgccaucaaccaggugcggucccugaucgggaacgaggaguacaccgacuacaugcccagcaugaagcgcuuccggcgcgaggaggaggaggcgggcguccucugguga

SEQ ID NO: 9323 - RNA, 9876 nt, Artificial Sequence
  derived and/or modified CDS sequence (opt1) from DENV-2__KF955359__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaccauggccgcgauccuggccuacaccaucgggacgacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccauccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgccagccucguccuggugggcaucgugacccuguaccucggggucauggugcaggcggacaccggcugcguggucuccuggaagaacaaggagcugaagugcggcagcgggaucuucaucacggacaacgugcacaccuggaccgagcaguacaaguuccagcccgagucccccagcaagcuggccagcgccauccagaaggcccacgaggagggcaucugcgggauccgguccgugacccgccucgagaaccugauguggaagcagaucacgcccgagcugaaccacauccucagcgagaacgaggucaagcugaccaucaugaccggcgacaucaaggggaucaugcaggccggcaagcggucccugcgcccgcagcccaccgagcucaaguacagcuggaagacguggggcaaggcgaagaugcuguccaccgagagccacaaccagaccuuccugaucgacgggcccgagaccgccgagugcccgaacacgaaccgggccuggaacucccucgagguggaggacuacggcuucgggguguucagcaccaacaucuggcugaagcugcgcgagaagcaggacgucuucugcgacuccaagcucaugagcgccgccaucaaggacaaccgggcggugcacgccgacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucaccaucauggccaucuccugcgugccgaacgccgugauccugcagaacgcguggaaggucagcugcacgauccucgccgccguguccgugagcccccugcugcucaccuccagccagcagaaggccgacuggaucccccuggcgcugaccaucaagggccucaaccccaccgccaucuuccugacgacccugucccggaccagcaagaagcgcuccuggccgcucaacgaggccgucauggccgugggcauggucagcauccuggccuccagccugcucaagaacgacauccccaugaccgggccccugguggcgggcgggcugcucacggugugcuacguccugaccggccggagcgccgaccuggagcucgagaaggccgccgacgugaagugggaggaccaggccgagaucuccgggagcucccccauccugagcaucaccaucuccgaggacggcagcauguccaucaagaacgaggaggaggagcacacccugacgauccucauccgcaccggccugcuggugaucagcggggucuucccgguguccauccccaucaccgcggccgccugguaccucugggaggugaagaagcagcgggccggcguccugugggacgugcccagcccgccgcccguggggaaggccgagcuggaggacggcgcguaccgcaucaagcagcgggggaucuucggcuacucccagaucggcgccggggucuacaaggagggcaccuuccacaccauguggcacgugacgcgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagaccaacaccgggacgaucggcgccgugagccucgacuucucccccggcaccagcgggucccccaucguggaccgcaagggcaaggucguggggcuguacggcaacggcguggucacccggagcggggccuacguguccgccaucgcgcagaccgagaaguccaucgaggacaaccccgagaucgaggacgacaucuuccgcaagaagcggcugacgaucauggaccuccaccccggcgccgggaagaccaagcgcuaccugcccgccaucgugcgggaggccaucaagcgcggccugcggacccugauccucgccccgacccgcgucguggcggccgagauggaggaggcccugcgcgggcugcccauccgguaccagacgcccgccauccgcgccgagcacaccggccgggagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggggaggcggccggcaucuucaugaccgccacgccgcccgggucccgcgacccguucccccagagcaacgcccccaucauggacgaggagcgggagauccccgagcgcuccuggaacagcggccacgagugggucacggacuucaaggggaagaccgugugguucgugccguccaucaaggcgggcaacgacaucgccgccugccugcggaagaacggcaagaaggucauccagcugagccgcaagaccuucgacuccgaguacgugaagacccgggccaacgacugggacuucguggucacgaccgacaucagcgagaugggggccaacuuccgcgcggagcgggugaucgacccccgccggugcaugaagcccgugauccucaccgacggcgaggagcgcgucauccuggccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuaccgcguggccgcggagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcccggaucuacagcgacccccucgcccugaaggaguucaaggaguucgcggccggccgcaagucccugacccucaaccugaucacggagauggggcggcugcccaccuucaugacccagaaggcccgcgacgcccucgacaaccuggccgugcugcacaccgcggaggucggcgggcgggccuacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucaccuacguggugaucgccauccugacggucguggccgcgaccauggccaacgagaugggguuccuggagaagaccaagaaggaccucggccugggcagcaucaccacgcaggagagcgaguccaacauccuggacaucgaccuccggccggccagcgccuggacccuguacgccguggcgaccaccuucgucacgcccaugcugcgccacuccaucgagaacagcuccgugaacgugagccucaccgccaucgccaaccaggccaccguccugauggggcugggccggggguggccccucuccaagauggacaucggcgugccccugcuggcgaucgggugcuacagccaggugaacccgaucacccucacggccgcccugcugcuccuggucgcccacuacgccaucaucggccccggccugcaggcgaaggccacccgcgaggcccagaagcgcaccgccgccgggaucaugaagaaccccaccguggacggcaucacggugaucgaccucgagcccaucccguacgaccccaaguucgagaagcagcuggggcaggucaugcugcucgugcugugcgugacccagguccugaugaugcggaccaccugggcgcucugcgaggcccugacgcuggccaccggccccaucuccacccucugggaggggaaccccggccgcuucuggaacaccacgaucgccgugagcauggccaacaucuuccggggcuccuaccuggcgggggccggccuccucuucagcaucaugaagaacaccaccaacacccgccgggggacgggcaacaucggcgagacccugggggagaaguggaagucccgccugaacgcccucggcaagagcgaguuccagaucuacaagaaguccgggauccaggagguggaccggacccuggccaaggagggcaucaagcgcggggagaccgaccaccacgcggucagccggggcuccgccaagcugcgcugguucguggagcggaacauggugacgccggagggcaaggucguggaccucgggugcggccgcgggggcuggagcuacuacugcgggggccugaagaacgugcgggaggucaagggccugaccaagggcgggcccgggcacgaggagcccauccccauguccaccuacggcuggaaccucgugcgccugcagagcgggguggacgucuucuucaccccgcccgagaagugcgacacgcugcucugcgacaucggcgagagcucccccaaccccaccaucgaggccggccggacccugcgcgugcugaaccucguggagaacuggcugaacaacaacacccaguucugcgucaaggugcugaacccguacaugcccagcgugaucgagaagauggagacccuccagcggaaguacgggggcgcccugguccgcaacccccugucccggaacagcacgcacgagauguacuggguguccaacgccaccgggaacaucgugagcuccgucaacaugaucagccgcaugcugaucaaccgcuucaccaugaagcacaagaaggcgaccuacgagccggacguggaccucggcuccgggacgcggaacaucggcaucgagaacgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgccuccagcauggugaacggggucgugaagcugcucaccaagcccugggacguggucccgauggugacccagauggccaugaccgacacgacccccuucggccagcagcggguguucaaggagaaggucgacacccgcacccaggagcccaaggagggcacgaagaagcugaugcggaucaccgccgaguggcuguggaaggagcucgggaagaagaagacgccccgcaugugcacccgggaggaguucacgcgcaaggugcgguccaacgcggcccugggcgccaucuucaccgacgagaacaaguggaaguccgcccgcgaggccguggaggacucccgguucugggagcuggucgaccgcgagcggaaccuccaccuggaggggaagugcgagaccugcguguacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggggaacagccugagcggcgucgagggggagggccugcacaagcucggcuacauccugcgcgacguguccaagaaggagggcggggcgauguacgccgacgacaccgccgggugggacacgcggaucacccuggaggaccucaagaacgaggagauggugaccaaccacaugaagggcgagcacaagaagcuggccgaggccaucuucaagcugaccuaccagaacaaggucgugcgcgugcagcggccgacgccccgcgggaccgucauggacaucaucagccgcaaggaccagcggggcuccggccagguggggaccuacggccucaacaccuucacgaacauggaggcgcagcugauccgccagauggagggggagggcaucuucaagagcauccagcggcugaccgugaccgaggagaucgccguccagaacuggcucgcccgcgugggccgggagcgccugucccggauggccaucagcggggacgacugcguggucaagccccuggacgaccgcuucgccuccgcgcucaccgcccugaacgacaugggcaaggugcggaaggacauccagcagugggagcccagccgcggguggaacgacuggacccaggugccguucugcucccaccacuuccacgagcuggucaugaaggacggccggaugcucguggugcccugccgcaaccaggacgagcugaucgggcgggcccgcaucagccagggcgccggcuggucccugaaggagaccgccugccucggcaagagcuacgcgcagauguggacccugauguacuuccaccggcgcgaccugcggcucgccgccaacgccaucugcuccgccguccccagccacugggugcccaccucccgcaccacguggagcauccacgcgaagcacgaguggaugaccaccgaggacaugcuggccguguggaaccgggucuggauccaggagaacccguggauggaggacaagacccccguggaguccugggaggaggugcccuaccugggcaagcgcgaggaccaguggugcgggagccucaucggccugacgagccgcgccaccugggccaagaacauccagaccgcgaucaaccagguccggucccugaucgggaacgaggaguacaccgacuacaugcccagcaugaagcgcuuccggaaggaggaggaggaggccggcgugcucugguga

SEQ ID NO: 9324 - RNA, 9876 nt, Artificial Sequence
  derived and/or modified CDS sequence (opt1) from DENV-2__KF955360__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcgccaccaccggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccuguucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggacaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggugaugguccaggcggacuccggcugcguggugagcuggaagaacaaggagcugaagugcggcuccgggaucuucaucaccgacaacguccacaccuggacggagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugaccaucaugacgggcgacaucaaggggaucaugcaggccggcaagcggagccugcgcccgcagcccaccgagcucaaguacuccuggaagaccuggggcaaggcgaagaugcugagcaccgagucccacaaccagacguuccugaucgacgggcccgagaccgccgagugcccgaacaccaaccgggccuggaacagccucgaggucgaggacuacggcuucgggguguucuccaccaacaucuggcugaagcugcgcgagaagcaggacguguucugcgacagcaagcucauguccgccgccaucaaggacaaccgggcgguccacgccgacaugggcuacuggaucgagagcgcccugaacgacacguggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgcggggcccuggcaccugggcaagcuggagauggacuucgacuucugcgaggggaccacggucguggugaccgaggacugcggcaaccggggccccagccuccgcaccaccacggccuccgggaagcugaucaccgaguggugcugccggagcugcacccugcccccgcuccgcuaccggggcgaggacgggugcugguacggcauggagauccgcccccugaaggagaaggaggagaaccuggucaacucccucgugaccgccgggcacggccagaucgacaacuucagccugggcgugcuggggauggcccucuuccuggaggagaugcugcggacgcgcgucggcaccaagcacgcgauccuccugguggccguguccuucgucacccugaucaccgggaacaugagcuuccgggaccucggccgcgugauggugauggucggggccacgaugaccgacgacaucggcaugggcgugaccuaccuggcccugcucgccgcguucaaggugcgccccaccuucgccgccgggcugcugcuccggaagcugacguccaaggagcugaugauggccaccaucggcaucgcccuccugagccaguccaccauccccgagaccauccuggagcucacggacgcgcuggcccuggggaugaugguccucaagaucgugcgcaacauggagaaguaccagcuggccgugaccaucauggccaucagcugcgucccgaacgccgugauccugcagaacgcguggaagguguccugcaccauccucgccgccgucagcgugagcccccugcugcucaccagcucccagcagaaggccgacuggaucccccuggcgcugacgaucaagggccucaaccccaccgccaucuuccugaccacccugagccggacguccaagaagcgcagcuggccgcucaacgaggccgucauggccgugggcaugguguccauccuggccagcagccugcucaagaacgacauccccaugaccgggccccuggucgcgggcgggcugcucaccgugugcuacgugcugaccggccgguccgccgaccuggagcucgagcgcgccgccgacgucaagugggaggaccaggccgagaucagcggguccagccccauccuguccaucacgaucagcgaggacggcuccaugagcaucaagaacgaggaggaggagcacacccugaccauccucauccggaccggccugcuggugaucuccgggguguucccggucagcauccccaucacggcggccgccugguaccucugggaggugaagaagcagcgcgccggcgugcugugggacguccccagcccgccgcccguggggaaggccgagcuggaggacggcgcguaccggaucaagcagcgcgggaucuucggcuacagccagaucggcgccgggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgcggugcagaccaagcccggccuguucaagacgaacaccgggaccaucggcgccgucucccucgacuucagccccggcaccuccgggagccccaucguggaccggaagggcaagguggucgggcuguacggcaacggcguggugacgcgcuccggggccuacgucagcgccaucgcgcagaccgagaaguccaucgaggacaaccccgagaucgaggacgacaucuuccggaagaagcgccugaccaucauggaccuccaccccggcgccgggaagaccaagcgguaccugcccgccaucgugcgcgaggccaucaagcggggccugcgcacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcggcugcugucccccgugcgcgucccgaacuacaaccucaucaucauggacgaggcccacuucaccgaccccgccagcaucgccgcccggggcuacaucuccacccgcguggagaugggggaggcggccggcaucuucaugacggccacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggcgggcaacgacaucgccgccugccugcgcaagaacggcaagaaggugauccagcugucccggaagacguucgacagcgaguacgucaagacccgcgccaacgacugggacuucguggugaccaccgacaucuccgagaugggggccaacuuccgggcggagcgcgucaucgacccccggcgcugcaugaagcccgugauccucacggacggcgaggagcgggugauccuggccgggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgggagaagguggacgccaucgacggggaguaccgccugcggggcgaggcccgcaagaccuucguggaccucaugcggcgcggggaccugcccgucuggcuggccuaccggguggccgcggagggcaucaacuacgccgaccgccgguggugcuucgacgggaucaagaacaaccagauccucgaggagaacguggaggucgagaucuggacgaaggagggcgagcgcaagaagcugaagccgcgguggcuggacgcccgcaucuacuccgacccccucgcccugaaggaguucaaggaguucgcggccggccggaagucccugacccucaaccugaucaccgagauggggcgccugcccaccuucaugacgcagaaggcccgggacgcccucgacaaccuggccgugcugcacaccgcggaggucggcgggcgcgccuacaaccacgcccucuccgagcugcccgagacccuggagacccuccugcugcucacgcugcuggccaccgugaccggcggcaucuuccucuuccugaugagcgggaagggcaucgggaagaugacccugggcaugugcugcaucaucacggccuccauccuccugugguacgcgcagauccagccgcacuggaucgccgccagcaucauccuggaguucuuccucaucgugcugcugauccccgagcccgagaagcagcggacgccccaggacaaccagcucaccuacgucgugaucgccauccugaccguggucgccgcgaccauggccaacgagaugggguuccuggagaagacgaagaaggaccucggccugggcagcaucaccacccaggaguccgagagcaacauccuggacaucgaccuccgcccggccuccgccuggacccuguacgccguggcgacgaccuucgugacccccaugcugcggcacagcaucgagaacuccagcgucaacgugucccucaccgccaucgccaaccaggccacggugcugauggggcugggccgcggguggccccucagcaagauggacaucggcgucccccugcuggcgaucgggugcuacucccaggugaacccgaucacccucaccgccgcccugcugcuccugguggcccacuacgccaucaucggccccggccugcaggcgaaggccacccgcgaggcccagaagcggacggccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcacgaccugggcgcucugcgaggcccugacccuggccaccggccccaucagcacgcucugggaggggaaccccggccgguucuggaacaccaccaucgccgucuccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggugucccgcggcagcgccaagcugcggugguucgucgagcgcaacauggugaccccggagggcaagguggucgaccucgggugcggccgcggcgggugguccuacuacugcggcgggcugaagaacgugcgcgaggugaaggggcugaccaagggcgggcccgggcacgaggagcccauccccaugagcacguacggcuggaaccucguccggcugcagagcgggguggacguguucuucaccccgcccgagaagugcgacacccugcucugcgacaucggcgaguccagccccaaccccaccaucgaggccggccgcacgcugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccaccgggaacaucgucuccagcgugaacaugaucucccgcaugcugaucaaccgguucacgaugaagcacaagaaggcgaccuacgagccggacguggaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggucaacgggguggugaagcugcucaccaagcccugggacgucgugccgauggugacgcagauggccaugaccgacaccacccccuucggccagcagcgcgucuucaaggagaagguggacacgcggacccaggagcccaaggagggcaccaagaagcugaugcgcaucaccgccgaguggcuguggaaggagcucgggaagaagaagacgccccggaugugcacccgcgaggaguucacccggaaggugcgcagcaacgcggcccugggcgccaucuucaccgacgagaacaaguggaaguccgcccgggaggccgucgaggacagccgcuucugggagcugguggaccgggagcgcaaccuccaccuggaggggaagugcgagacgugcgucuacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggggcgauguacgccgacgacaccgccgggugggacacccgcaucacccuggaggaccucaagaacgaggagauggucacgaaccacaugaagggcgagcacaagaagcuggccgaggccaucuucaagcugaccuaccagaacaagguggugcggguccagcgcccgacgccccgggggaccgugauggacaucaucucccggaaggaccagcgcggcagcggccagguggggacguacggccucaacaccuucaccaacauggaggcgcagcugauccggcagauggagggggagggcaucuucaaguccauccagcgccugaccgucacggaggagaucgccgugcagaacuggcucgcccgggugggccgcgagcggcugagccgcauggccaucuccggggacgacugcgucgugaagccccuggacgaccgguucgccagcgcgcucaccgcccugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagaccgccugccucgggaaguccuacgcgcagauguggacgcugauguacuuccaccgccgggaccugcgccucgccgccaacgccaucugcagcgccgugcccucccacuggguccccaccagccggaccaccugguccauccacgcgaagcacgaguggaugaccacggaggacaugcuggccguguggaaccgcguguggauccaggagaacccguggauggaggacaagacccccgucgagagcugggaggaggugcccuaccugggcaagcgcgaggaccaguggugcgggagccucaucggccugaccucccgggccaccugggccaagaacauccagacggcgaucaaccaggugcgcagccugaucgggaacgaggaguacaccgacuacaugcccuccaugaagcgguuccgcaaggaggaggaggaggccggcguccucugguga

SEQ ID NO: 9325 - RNA, 9876 nt, Artificial Sequence
  derived and/or modified CDS sequence (opt1) from DENV-2__KF955363__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccucgagaaccugauguggaagcaggucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucaccaucauggccaucuccugcgugccgaacgccgugauccugcagaacgcguggaaggucagcugcacgauccucgccgccguguccgucagcccccugcugcucaccuccagccagcagaaggccgacuggaucccccuggcgcugaccaucaagggccucaaccccaccgccaucuuccugacgacccugucccggaccagcaagaagcgcuccuggccgcucaacgaggccaucauggccgugggcauggugagcauccuggccuccagccugcucaagaacgacauccccaugaccgggccccuggucgcgggcgggcugcucacggugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacccugacgauccucauccggaccggccugcuggugaucagcgggguguucccggucuccauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacucccagaucggcgccgggguguacaaggagggcaccuuccacaccauguggcacgucacgcgcggggccgugcugaugcaccgcggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgcggugcagaccaagcccggccucuucaagaccaacaccgggacgaucggcgccgucagccuggacuucucccccggcaccagcgggucccccaucguggaccggaagggcaagguggucgggcuguacggcaacggcguggugacccgcagcggggccuacgucuccgccaucgcgcagaccgagaaguccaucgaggacaaccccgagaucgaggacgacaucuuccggaagaagcgccucacgaucauggaccugcaccccggcgccgggaagaccaagcgguaccugcccgccaucgugcgcgaggccaucaagcggggccugcgcacccucauccuggccccgacccgcguggucgcggccgagauggaggaggcccugcgggggcuccccauccgcuaccagacgcccgccauccgggccgagcacaccggccgcgagaucguggaccugaugugccacgcgaccuucaccaugcggcugcucagccccgugcgcgucccgaacuacaaccugaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggcgggcaacgacaucgccgccugccugcgcaagaacggcaagaaggugauccagcucagccggaagaccuucgacuccgaguacgucaagacccgcgccaacgacugggacuucguggugacgaccgacaucagcgagaugggggccaacuucaaggcggagcgggucaucgacccccgccggugcaugaagcccgugauccugaccgacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacgcccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacagcgacccccuggcccugaaggaguucaaggaguucgcggccggccgcaagucccucacccugaaccugaucacggagauggggcggcuccccaccuucaugacccagaaggcccgcgacgcccuggacaaccuggccgugcuccacaccgcggaggccggcgggaaggccuacaaccacgcccugagcgagcugcccgagacgcucgagacccugcugcuccugacccugcucgccaccgucacgggcggcaucuuccuguuccugauguccgggaagggcaucgggaagaugacccucggcaugugcugcaucaucaccgcgagcauccugcugugguacgcccagauccagccgcacuggaucgccgccuccaucauccucgaguucuuccugaucgugcugcucauccccgagcccgagaagcagcggacgccccaggacaaccagcugaccuacguggucaucgccauccugacggugguggcggccaccauggccaacgagaugggguuccucgagaagaccaagaaggaccugggccugggcagcaucaccacgcaggagagcgaguccaacauccucgacaucgaccugcgcccggccagcgccuggacccuguacgcggucgccaccaccuucgugacgcccaugcuccggcacuccaucgagaacagcuccgugaacgucagccugaccgccaucgccaaccaggcgaccgugcugauggggcucggcaagggguggccccuguccaagauggacaucggcgugccccugcucgccaucgggugcuacagccaggucaacccgaucacccugacggccgcccugcuccugcugguggcccacuacgcgaucaucggccccggccuccaggccaaggccacccgcgaggcccagaagcgggccgcggccgggaucaugaagaaccccaccguggacggcaucaccgucaucgaccuggagcccaucccguacgaccccaaguucgagaagcagcugggccaggugaugcuccugauccugugcgugacgcagguccucaugaugcgcaccaccugggcccugugcgaggcccugacccucgccacgggccccaucuccacccugugggaggggaaccccggccgcuucuggaacaccaccaucgcggugagcauggccaacaucuuccggggcuccuaccuggccggggccggccuccuguucagcaucaugaagaacacgaccaacacccgccgggggaccggcaacaucggcgagacgcugggggagaaguggaagucccgccucaacgcgcugggcaagagcgaguuccagaucuacaagaaguccgggauccaggagguggaccggacccuggccaaggagggcaucaagcgcggggagaccgaccaccacgccgucagccggggcuccgccaagcuccgcugguucguggagcggaacauggugaccccggagggcaaggucguggaccuggggugcggccgcgggggcuggagcuacuacugcgggggccugaagaacgugcgggaggucaagggccucacgaagggcgggcccgggcacgaggagcccauccccauguccaccuacggcuggaaccuggugcgccugcagagcgggguggacgucuucuucaccccgcccgagaagugcgacacccuccugugcgacaucggcgagagcucccccaaccccacgaucgaggccggccggacccugcgcgugcucaaccugguggagaacuggcugaacaacaacacccaguucugcaucaagguccucaacccguacaugcccagcgugaucgagaagauggagacccugcagcggaaguacgggggcgcgcuggugcgcaacccccugucccggaacagcacccacgagauguacugggucuccaacgccacggggaacaucgugagcuccgugaacaugaucagccgcaugcucaucaaccgguucaccaugaagcacaagaaggccaccuacgagccggacgucgaccugggcuccgggacccgcaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggugguccggcuccugacgaagcccugggacguggugccgauggucacccagauggcgaugaccgacaccacgcccuucggccagcagcgcguguucaaggagaagguggacacccggacccaggagcccaaggagggcaccaagaagcugaugaagaucacggccgaguggcucuggaaggagcuggggaagaagaagacgccccggaugugcacccgggaggaguucacccgcaagguccggagcaacgccgcccugggcgccaucuucacggacgagaacaaguggaaguccgcgcgcgaggccguggaggacagccgguucugggagcucguggaccgcgagcggaaccugcaccuggaggggaagugcgagaccugcgucuacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggggaacagccuguccggcguggagggggagggccuccaccgccugggcuacauccugcgggacgucagcaagaaggagggcggggccauguacgccgacgacaccgccgggugggacacccgcaucacgcucgaggaccugaagaacgaggagauggugaccaaccacaugaagggcgagcacaagaagcuggcggaggccaucuucaagcucaccuaccagaacaaggugguccgggugcagcgcccgacgccccgggggacggugauggacaucaucucccgccgcgaccagcggggcagcggccaggucgggaccuacggccugaacaccuucaccaacauggaggcccagcugauccgccagauggagggggagggcaucuucaaguccauccagcaccucacggugaccgaggagaucgccgugcagaacuggcuggcccgggucggccgcgagcggcugagccgcauggugaucuccggggacgacugcguggucaagccccucgacgaccgguucgcgagcgcccugaccgcccugaacgacaugggcaaggugcgcaaggacauccagcagugggagcccucccggggguggaacgacuggacccaggugccguucugcagccaccacuuccacgagcucgucaugaaggacggccgcgugcuggugguccccugccggaaccaggacgagcugaucgggcgcgcccggaucucccagggcgccggcuggagccucaaggagacggcgugccuggggaaguccuacgcccagauguggacccugauguacuuccaccgccgggaccuccgccuggccgccaacgccaucugcagcgcggugcccucccacugggugcccaccagccggaccaccugguccauccacgccaagcacgaguggaugacgaccgaggacaugcuggccgucuggaaccgcguguggauccaggagaacccguggauggaggacaagacccccguggagagcugggaggagguccccuaccucggcaagcgggaggaccaguggugcgggagccugaucggccugaccucccgcgccacgugggcgaagaacauccagaccgccaucaaccaggugcgcagccucaucgggaacgaggaguacaccgacuacaugcccuccaugaagcgguuccgccgggaggaggaggaggccggcgugcugugguga

SEQ ID NO: 9326 - RNA, 9876 nt, Artificial Sequence
  derived and/or modified CDS sequence (opt1) from DENV-2__EU726767__SS-prME
agcgcgggcaugaucaucaugcugauccccaccgugauggccuuccaccucaccacccgcaacggggagccccacaugaucgugucccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacuccaccagcaccugggugaccuacgggacgugcgccaccaccggcgagcaccggcgcgagaagcgguccguggcccuggugccccacgugggcauggggcucgagacccgcacggagaccuggaugagcuccgagggcgccuggaagcacgcccagcggaucgagaccuggauccugcgccacccgggguucaccaucauggcggccauccuggccuacacgaucggcaccacccacuuccagcgggcccucaucuucauccugcugaccgcggucgcccccagcaugacgaugcgcugcaucgggaucuccaaccgggacuucguggagggcgugagcggcggguccugggucgacaucgugcucgagcacggcagcugcgugaccaccauggccaagaacaagcccacccuggacuucgagcugaucaagacggaggccaagcagcccgccacccuccgcaaguacugcaucgaggcgaagcugaccaacaccacgaccgagucccggugccccacccagggggagcccagccugaaggaggagcaggacaagcgcuucgucugcaagcacuccaugguggaccggggcuggggcaacgggugcggccucuucgggaagggcgggaucgugaccugcgccauguucacgugcaagaagaacauggagggcaagaucguccagcccgagaaccuggaguacaccaucguggugacgccccacagcggcgaggagcacgccgucgggaacgacaccggcaagcacgggaaggagaucaaggugacgccgcaguccagcaucaccgaggccgagcugaccggcuacgggaccgugaccauggagugcagcccccgcacgggccucgacuucaacgagaugguccugcugcagauggagaacaaggccuggcucgugcaccggcagugguuccuggaccugccccuccccuggcugccgggcgcggacacccaggggagcaacuggauccagaaggagacccuggugaccuucaagaacccccacgccaagaagcaggacgucgugguccucggcagccaggagggggccaugcacacggcccugaccggcgccaccgagauccagauguccagcgggaaccuccuguucaccggccaccugaagugccgccugcggauggacaagcuccagcugaagggcauguccuacagcaugugcacggggaaguucaagguggugaaggagaucgcggagacccagcacggcaccaucgucauccgcgugcaguacgagggggacggcucccccugcaagauccccuucgagaucauggaccuggagaagcgguacgugcucggccgccugaucaccgucaacccgaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcgcggcgccaagcggauggccauccugggcgacaccgccugggacuucgggagccugggcgggguguucacguccaucggcaaggcgcuccaccagguguucggggccaucuacggcgccgccuucagcggcgucuccuggaccaugaagauccugaucggggugaucaucaccuggaucggcaugaacagccgcuccaccagccuguccgugagccugguccucguggggaucgugacgcuguaccugggcgucauggugcaggcggacuccgggugcguggucagcuggaagaacaaggagcucaagugcggcagcggcaucuucaucaccgacaacgugcacaccuggaccgagcaguacaaguuccagcccgagucccccagcaagcuggccuccgccauccagaaggcccaggaggaggggaucugcggcauccggagcgugacgcgccuggagaaccucauguggaagcagaucacccccgagcugaaccacauccuggccgagaacgaggucaagcucaccaucaugaccggggacgugaagggcaucaugcaggcggggaagcggucccugcgcccgcagcccacggagcugaaguacagcuggaagaccuggggcaaggccaagaugcucuccaccgagagccacaaccagaccuuccugaucgacggccccgagacggccgagugcccgaacaccaaccgggccuggaacucccuggagguggaggacuacggguucggcgucuucaccaccaacaucuggcucaagcugaaggagaagcaggacgccuucugcgacagcaagcugauguccgcggccaucaaggacaaccgcgccgugcacgccgacaugggguacuggaucgagagcgcccucaacgacacguggaagaucgagaaggcguccuucaucgaggugaagaacugccacuggcccaagagccacacccugugguccaacggcguccuggagagcgagaugaucauccccaagaaccucgccggccccgugucccagcacaacuaccggccgggguaccacacccagaucgccggccccuggcaccuggggaagcuggagauggacuucgacuucugcgagggcaccaccguggucgugacggaggacugcgggaaccgcggccccagccuccggaccaccaccgccagcggcaagcugaucacggaguggugcugccgcuccugcacccugcccccgcuccgguaccgcggggaggacggcugcugguacgggauggagauccggccccugaaggagaaggaggagaaccuggugaacagccucgucaccgcgggccacggccagguggacaacuucucccugggcgugcugggcauggcccucuuccuggaggagaugcugcgcacccgggucgggacgaagcacgccauccuccugguggccgugagcuucaugacccugaucaccggcaacauguccuucaaggaccucgggcgcgucguggugauggucggcgccgcgaugaccgacgacaucgggaugggcgugacguaccuggcccugcucgccgccuucaaggugcggcccaccuucgccgcgggccugcugcuccgcaagcugaccagcaaggagcugaugaugaccacgaucgggaucgcccuccugucccagagcaccauccccgagaccauccuggagcucaccgacgcccuggcccugggcaugaugguccucaagauggugcgcaacauggagaaguaccagcuggccgugacgaucauggcgauccugugcgucccgaacgccgugauccuccagaacgccuggaaggucuccugcaccauccuggccguggugagcgucagcccccugcuccugaccagcucccagcagaagaccgacuggaucccccuggcgcucacgaucaaggggcugaaccccaccgccaucuuccugaccacccucagccggacguccaagaagcgcagcuggccgcugaacgaggccaucauggccgugggcaugguguccauccuggccagcucccuccugaagaacgacauccccaugaccggcccccuggucgccggcgggcuccugaccgugugcuacgugcugaccgggcggagcgccgaccucgagcuggagcgcgccacggacgucaagugggaggaccaggccgagaucagcggguccagccccauccuguccaucaccaucagcgaggacggguccaugagcaucaagaacgaggaggaggagcagacccucaccauccugauccggacgggccugcucgugaucuccggccuguucccggugagcauccccaucaccgccgcggccugguaccugugggaggucaagaagcagcgcgccggggugcucugggacgugcccagcccgccgcccaugggcaaggccgagcuggaggacggggccuaccggaucaagcagaagggcauccugggguacagccagaucggcgcgggcgucuacaaggaggggaccuuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcccuggagcccggcaagaacccccgcgccguccagacgaagcccgggcuguucaagaccaacgcgggcaccaucggggccgugucccucgacuucagccccggcaccuccggcagccccaucaucgacaagaaggggaagguggucggccuguacgggaacggcguggugacgcgguccggcgccuacgucagcgccaucgcgcagaccgagaaguccaucgaggacaaccccgagaucgaggacgacaucuuccgcaagcggcgccugaccaucauggaccugcaccccggggccggcaagaccaagcgguaccuccccgccaucgugcgcgaggccaucaagcgggggcugcgcacgcugauccucgccccgacccggguggucgcggccgagauggaggaggcccugcgcggccugcccauccgguaccagacccccgccauccgcgccgagcacaccgggcgcgagaucguggaccucaugugccacgcgacguucaccaugcggcugcugagccccgugcgcgucccgaacuacaaccucaucaucauggacgaggcccacuucaccgaccccgccagcaucgccgcccggggcuacaucuccacccgcguggagaugggcgaggcggccgggaucuucaugacggccacgccgcccggcagccgggacccguucccccaguccaacgcccccaucaucgacgaggagcgcgagauccccgagcggagcuggaacuccgggcacgagugggugaccgacuucaagggcaagaccgucugguucgugccgagcaucaaggcggggaacgacaucgccgccugccugcgcaagaacggcaagaaggugauccagcugucccggaagacguucgacagcgaguacgucaagacccgcaccaacgacugggacuucguggugaccacggacaucuccgagaugggcgccaacuucaaggccgagcgggucaucgacccccgccggugcaugaagcccgugauccucaccgacggggaggagcgcgugauccuggcgggccccaugccggucacccacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccggaagacguucguggaccucaugcgccggggcgaccugcccgucuggcuggccuacaagguggccgccgaggggaucaacuacgcggaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccacguucaugacccagaagacccgggacgcccucgacaaccuggccgugcugcacaccgccgaggccgggggccgcgcguacaaccacgcccucuccgagcugcccgagacgcuggagacccuccugcugcucacccugcuggccaccgucaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacguggucaucgccauccugacggugguggccgccaccauggcgaacgagaugggcuuccuggagaagaccaagaaggaccucgggcugggcuccaucgucacccagcagccggagagcaacauccuggacaucgaccuccggcccgccagcgccuggacgcuguacgccguggccaccaccuucgugacccccaugcugcgccacuccaucgagaacagcuccgucaacgugagccucacggcgaucgccaaccaggccaccgugcugaugggccuggggaagggcuggccccucuccaagauggacaucggggucccgcugcuggccaucggcugcuacagccaggugaaccccaucacccucaccgcggcccugcugcuccugguggcccacuacgccaucaucgggcccggccugcaggccaaggcgacgcgggaggcccagaagcgcgccgccgccggcaucaugaagaaccccaccgucgacgggaucaccgugaucgaccucgacccgauccccuacgaccccaaguucgagaagcagcugggccaggugaugcugcucguccugugcgugacccaggugcugaugaugcggacgaccugggcgcucugcgaggcccugacccuggccaccgggcccaucuccacgcucugggagggcaacccggggcgcuucuggaacaccaccaucgccgucagcauggccaacaucuuccggggcuccuaccuggcgggcgccgggcuccuguucagcaucaugaagaacaccacgaacacccgccgcggcaccgggaacaucggcgagacccugggcgagaaguggaagucccggcugaacgcccucgggaaguccgaguuccagaucuacaagaaguccggcauccaggagguggaccgcacgcuggccaaggaggggaucaagcggggcgagaccgaccaccacgcggugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugaccaagggcgggcccggccacgaggagcccaucccgauguccacguacggguggaaccucguccggcugcagagcggcguggacguguucuucaucccgcccgagaagugcgacacccugcucugcgacaucggggaguccagccccaacccgaccgucgaggccggccgcacccugcgggugcugaaccucguggagaacuggcugaacaacaacacgcaguucugcaucaagguccugaaccccuacaugcccagcgugaucgagaagauggaggcccugcagcgcaaguacggcggggcccucgugcggaacccgcugucccgcaacagcacccacgagauguacugggucuccaacgcgagcggcaacaucguguccagcgugaacaugaucucccggaugcugaucaaccgcuucaccaugcggcacaagaaggccaccuacgagcccgacgucgaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccugcucacgaagccgugggacgugcugcccaccgugacccagauggccaugaccgacacgacccccuucgggcagcagcgcgucuucaaggagaagguggacacccggacccaggagcccaaggagggcacgaagaagcugaugaagaucaccgcggaguggcucuggaaggagcugggcaagaagaagaccccgcgcaugugcacccgggaggaguucacgcgcaaggugcgguccaacgccgcccugggggccgucuucaccgacgagaacaaguggaaguccgcccgcgaggcgguggaggacucccgguucugggagcucgucgacaaggagcgcagccugcaccuggagggcaagugcgagaccugcguguacaacaugauggggaagcgggagaagaagcucggcgaguucgggaaggccaagggcucccgcgccaucugguacauguggcugggcgcccgguuccuggaguucgaggcgcucggguuccugaacgaggaccacugguucagccgcgagaacagccuguccggcguggagggggagggccuccacaagcugggguacauccugcgggacgucagcaagaaggagggcggcgccauguacgccgacgacaccgccgggugggacacgcgcaucacccucgaggaccugaagaacgaggagauggugaccaaccacauggagggcgagcacaagaagcuggccgaggcgaucuucaagcucaccuaccagaacaaggugguccgggugcagcgccccacgccccgggggaccgugauggacaucaucucccgccgggaccagcgcggcagcgggcaggucggcaccuacggccugaacaccuucacgaacauggaggcccagcugauccggcagauggagggggagggcguguucaagaacauccagcaccucaccgugaccgaggagaucgccguccagaacuggcuggcccgcguggggcgcgagcggcugucccgcauggccaucagcggcgacgacugcguggucaagccccucgacgaccgguucgcguccgcccugaccgcccugaacgacaugggcaagauccgcaaggacauccagcagugggagccgagccggggguggaacgacuggacgcagguccccuucugcucccaccacuuccacgagcucaucaugaaggacggccgcgugcuggucgugcccugccggaaccaggacgagcugaucgggcgcgcccggaucagccagggcgccggguggucccuccgcgagaccgcgugccugggcaagagcuacgcccagauguggucccugauguacuuccaccggcgcgaccuccggcuggccgccaacgccaucugcagcgcggugcccucccacugggucccgaccagccgcaccacgugguccauccacgccaagcacgaguggaugaccaccgaggacaugcugaccguguggaaccggguguggauccaggagaaccccuggauggaggacaagacccccgucgagagcugggaggagauccccuaccucggcaagcgcgaggaccaguggugcgggagccugaucggccugacgucccgggccaccugggccaagaacauccaggcggccaucaaccaggugcgcagccucaucgggaacgaggaguacaccgacuacaugccguccaugaagcgguuccgccgcgaggaggaggaggccggcgugcugugguga

SEQ ID NO: 9327 - RNA, 9876 nt, Artificial Sequence
  derived and/or modified CDS sequence (opt1) from DENV-2__EU687246__SS-prME
agcgcgggcaugaucaucaugcugauccccaccgugauggcguuccaccucaccacccgcaacggggagccccacaugaucgugagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugcaagauccccuucgagaucauggaccuggagaagcgcuacgugcucggccggcugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccgagaccgccgagugcccgaacaccaaccgcgccuggaacucccuggagguggaggacuacggguucggcguguucaccacgaacaucuggcucaagcugaaggagaagcaggacgccuucugcgacagcaagcugauguccgccgcgaucaaggacaaccgggccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccgcccgggguaccacacccagaucgccggccccuggcaccuggggaagcuggagauggacuucgacuucugcgacggcaccacggugguggucaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugcggacgcgcguggggaccaagcacgccauccuccuggucgcccugagcuucgugacccucaucaccggcaacauguccuucaaggaccuggggcggguggucgugauggugggcgccacgaugaccgacgacaucgggaugggcgucaccuaccuggcccuccuggcggccuucaaggugcgccccaccuucgccgccggccugcuccugcggaagcugacgagcaaggagcucaugaugaccaccaucgggaucgugcugcugucccagagcaacauccccgagaccauccucgagcugacggacgcccuggcgcucggcaugaugguccugaagaucgugcgcgacauggagaaguaccagcuggccgugaccaucauggccauccucugcgucccgaacgccgugauccugcagaacgccuggaaggucuccugcaccauccuggcgguggugagcgucagcccccuccugcugaccagcucccagcagaagacggacuggaucccccucgcccugaccaucaaggggcugaaccccaccgccaucuuccucaccacgcugagccgcaccaacaagaagcgguccuggccgcugaacgaggccaucauggcggugggcauggugagcauccucgccuccagccugcugaagaacgacauccccaugaccggcccccucgucgccgggggccugcugaccgugugcuacgugcucacggggcgcuccgccgaccuggagcuggagcgggccaccgacgucaagugggaggaccaggcggagaucagcggcagcucccccauccucagcaucaccaucuccgaggacgggagcauguccaucaagaacgaggaggaggagcagacccugacgauccugauccgcaccggccuccuggugaucagcggccuguucccgguguccauccccaucaccgccgccgccugguaccucugggaggucaagaagcagcgggccggggugcugugggacgugcccuccccgccgcccaugggcaaggcggagcuggaggacggggccuaccgcaucaagcagaagggcauccucggguacucccagaucggcgccggcgucuacaaggaggggaccuuccacaccauguggcacgugacgcggggcgccgugcugaugcacaaggggaagcgcaucgagcccagcugggccgacgucaagaaggaccugaucuccuacggcgggggcuggaagcucgagggcgaguggaaggagggggaggagguccaggugcuggcgcuggagcccggcaagaacccccgggccguccagaccaagcccggccucuucaagaccaacaccggcacgaucggggccgugagccuggacuucucccccggcaccagcggcucccccaucaucgacaagaaggggaagguggucggccuguacgggaacggcguggugacccgcagcggcgccuacgucuccgccaucgcgcagaccgagaaguccaucgaggacaaccccgacaucgaggacgacaucuuccggaagcgccggcugacgaucauggaccuccaccccggggccggcaagaccaagcgcuaccugcccgccaucgugcgggaggccaucaagcgcgggcugcggacccucauccuggcgccgacccgcguggucgccgccgagauggaggaggcccugcggggccuccccauccgcuaccagacgcccgccauccgggcggagcacaccgggcgcgagaucguggaccugaugugccacgccaccuucaccaugcgccugcucucccccgugcgggucccgaacuacaaccugaucaucauggacgaggcccacuucacggaccccgccagcaucgccgcgcgcggcuacaucagcacccggguggagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugacggacuucaagggcaagaccgucugguucgugccguccaucaaggcggggaacgacaucgccgccugccugcggaagaacggcaagaaggugauccagcucagccgcaagaccuucgacuccgaguacaucaagacccggacgaacgacugggacuucgucgugaccaccgacaucagcgagaugggcgccaacuucaaggcggagcgcgugaucgacccccggcgcugcaugaagcccgucauccugaccgacggggaggagcgggugauccuggccggccccaugccggugacgcacuccagcgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccguccauguucgagcccgagcgcgagaaggucgacgccaucgacggcgaguaccggcuccgcggggaggcccgcaagaccuucguggaccugaugcggcgcggcgaccugcccguguggcucgccuacaaggucgccgcggaggggaucaacuacgccgaccggcgcuggugcuucgacggcaucaagaacaaccagauccuggaggagaacguggagguggagaucuggaccaaggagggggagcggaagaagcugaagccgcgcuggcucgacgcccggaucuacagcgacccccuggcccugaaggaguucaaggaguucgccgcgggccgcaagucccucacgcugaaccugaucaccgagaugggccggcuccccaccuucaugacccagaagacgcgcgacgcccuggacaaccuggccguccuccacaccgccgaggccggcgggcgggccuacaaccacgcccugagcgagcugcccgagacccucgagacccugcugcuccugacgcugcucgccaccgugaccggcgggaucuuccuguuccugauguccgggcgcgggaucggcaagaugacccucgggaugugcugcaucaucaccgccagcauccugcugugguacgcgcagauccagccgcacuggaucgccgccuccaucauccucgaguucuuccugaucguccugcucauccccgagcccgagaagcagcggacgccccaggacaaccagcugaccuacguggugaucgccauccugaccgucguggccgcgaccauggccaacgagaugggcuuccucgagaagacgaagaaggaccuggggcugggcagcaucgccacccagcagccggaguccaacauccucgacaucgaccugcgccccgccagcgccuggacccuguacgcgguggccaccacguucaucacccccaugcuccggcacagcaucgagaacuccagcgucaacgugucccugaccgccaucgccaaccaggccaccgugcugaugggccucgggaagggcuggccccugagcaagauggacaucggggucccgcugcucgcgaucggcugcuacucccaggugaaccccaucacgcugaccgccgcccugcuccugcugaucgcccacuacgcgaucaucgggcccggccuccaggccaaggccacccgcgaggcccagaagcgggccgcggccggcaucaugaagaaccccaccguggacgggaucacggucaucgaccuggacccgauccccuacgaccccaaguucgagaagcagcugggccaggugaugcuccuggugcugugcgucacccaggugcucaugaugcgcaccaccugggcccugugcgaggcccugacgcucgccaccgggcccaucagcacccugugggagggcaacccggggcgguucuggaacaccacgaucgcgguguccauggccaacaucuuccgcggcagcuaccuggccggcgccgggcuccuguucuccaucaugaagaacaccaccaacacccggcgcggcacggggaacaucggcgagacccugggcgagaaguggaagucccgccucaacgcccuggggaaguccgaguuccagaucuacaagaaguccggcauccaggaggucgaccggacccuggcgaaggaggggaucaagcgcggcgagaccgaccaccacgccgugucccgggggagcgccaagcuccgcugguucguggagcggaacauggucacgcccgagggcaaggugguggaccugggcugcgggcgcggcgggugguccuacuacugcggcgggcugaagaacguccgggaggugaagggccucaccaagggcgggcccggccacgaggagcccaucccgaugagcaccuacggguggaaccuggugcgccugcaguccggcgucgacguguucuucaucccgcccgagaagugcgacacccuccugugcgacaucggggagagcucccccaacccgacgguggaggccggccggacccugcgcguccucaaccugguggagaacuggcugaacaacaacacccaguucugcaucaaggugcugaaccccuacaugcccagcgucaucgagaagauggagacccuccagcggaaguacggcggggcgcuggugcgcaacccgcugagccggaacuccacccacgagauguacugggugagcaacgccuccggcaacaucgucagcuccgugaacaugaucagccgcaugcucaucaaccgguucacgaugcgccacaagaaggccaccuacgagcccgacguggaccugggguccggcacccggaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcggcuccugaccaagccgugggacguccugcccacggugacccagauggcgaugaccgacaccacgcccuucgggcagcagcgcguguucaaggagaaggucgacacccgcacccaggagcccaaggagggcaccaagaagcucaugaagaucacggccgaguggcuguggaaggagcugggcaagaagaagaccccgcggaugugcacccgcgaggaguucacccggaaggugcgcagcaacgccgcccucggggccaucuucacggacgagaacaaguggaaguccgcgcgggaggccguggaggacagccgcuucugggagcuggucgacaaggagcggaaccugcaccucgagggcaagugcgagaccugcguguacaacaugauggggaagcgcgagaagaagcugggcgaguucgggaaggccaagggcucccgggccaucugguacauguggcugggcgcccgcuuccucgaguucgaggcgcugggguuccugaacgaggaccacugguucagccgggagaacucccucagcggcguggagggggagggccugcacaagcugggguacauccuccgcgacgucagcaagaaggagggcggcgccauguacgccgacgacaccgccgggugggacacccggaucacgcuggaggaccugaagaacgaggagauggugaccaaccacauggagggcgagcacaagaagcucgcggaggccaucuucaagcugaccuaccagaacaaggucgugcgcgugcagcggcccacgccccgggggacggucauggacaucaucucccggcgcgaccagcggggcagcggccagguggggaccuacggccugaacaccuucaccaacauggaggcccagcucauccgccagauggagggggagggcguguucaagaacauccagcaccugacggucaccgaggagaucgccgugcagaacuggcuggcccggguggggcgcgagcgccucucccggauggcgaucagcggcgacgacugcgucgugaagccccuggacgaccgcuucgccuccgcccugaccgcccucaacgacaugggcaagauccggaaggacauccagcagugggagccgagccgcggguggaacgacuggacccaggugcccuucugcucccaccacuuccacgagcugaucaugaaggacggccggguccugguggugcccugccgcaaccaggacgagcucaucgggcgggcccgcaucagccagggcgcgggguggucccugcgggagacggccugccugggcaagagcuacgcccagauguggucccucauguacuuccaccgccgggaccugcgccuggccgccaacgcgaucugcagcgccguccccucccacugggugccgaccagccggaccaccugguccauccacgccaagcacgaguggaugaccacggaggacaugcucaccguguggaaccgcgucuggauccaggagaaccccuggauggaggacaagacccccguggagagcugggaggagauccccuaccugggcaagcgggaggaccaguggugcgggucccugaucggccucaccagccgcgccacgugggccaagaacauccaggcggccaucaaccaggugcggagccugaucggguccgaggaguacaccgacuacaugccgagcaugaagcgcuuccggcgcgaggaggaggaggccggcguccugugguga

SEQ ID NO: 9328 - RNA, 9876 nt, Artificial Sequence
  derived and/or modified CDS sequence (opt1) from DENV-2__FJ639828__SS-prME
agcgugggcaugaucaucaugcugauccccaccgucauggccuuccaccucaccacccgcaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacuccaccagcaccugggucaccuacgggaccugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggccaagcugacgaacaccaccaccgagucccgcugccccacgcagggggagcccagccugaaggaggagcaggacaagcgguucgugugcaagcacuccaugguggaccgcggcuggggcaacgggugcggccucuucgggaagggcgggaucgugaccugcgccauguucacgugcaagaagaacauggagggcaagaucgugcagcccgagaaccuggaguacaccaucguggucacgccccacagcggcgaggagcacgccguggggaacgacaccggcaagcacgggaaggagaucaaggugaccccgcaguccagcaucaccgaggcggagcugaccggcuacgggacggucaccauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacgcuggucaccuucaagaacccccacgccaagaagcaggacguggucgugcucggcagccaggagggggccaugcacaccgcgcugaccggcgccacggagauccagauguccagcgggaaccuccuguucaccggccaccugaagugccggcugcgcauggacaagcuccagcugaagggcauguccuacagcaugugcaccgggaaguucaagguggucaaggagaucgccgagacccagcacggcacgaucgugauccgggugcaguacgagggggacggcucccccugcaagauccccuucgagaucauggaccuggagaagcgcuacguccucggccggcugaucaccgugaacccgaucgccaccgagaaggacagccccgugaacaucgaggccgagccgcccuucggggacuccuacaucaucaucggcgucgagccggggcagcugaagcucaacugguucaagaagggcagcuccaucgggcagauguucgagaccacgaugcgcggcgcgaagcgcauggccauccugggcgacaccgccugggacuucgggagccugggcgggguguucaccuccaucggcaaggcccuccaccagguguucggggccaucuacggcgcggccuucagcggcgucuccuggaccaugaagauccugaucggggugaucaucacguggaucggcaugaacagccgguccaccagccuguccgugagccugguccucguggggguggucacccuguaccugggcgugauggugcaggccgacuccgggugcgucgugagcuggaagaacaaggagcucaagugcggcagcggcaucuucaucaccgacaacgugcacacguggaccgagcaguacaaguuccagcccgagucccccagcaagcuggccuccgcgauccagaaggcccaggaggaggggaucugcggcauccgcagcgucacccggcuggagaaccucauguggaagcagaucacccccgagcugaaccacauccuggccgagaacgaggugaagcucacgaucaugaccggggacaucaagggcaucaugcaggccgggaagcgcucccugcggccgcagcccaccgagcugaaguacagcuggaagaccuggggcaaggccaagaugcucuccacggagagccacaaccagaccuuccugaucgacggccccgagaccgcggagugcccgaacaccaaccgcgccuggaacucccuggagguggaggacuacggguucggcgucuucacgaccaacaucuggcucaagcugaaggagaagcaggacgccuucugcgacagcaagcugauguccgccgccaucaaggacaaccgggcggugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgccggccccgugucccagcacaacuaccgcccgggguaccacacccagaucgcgggccccuggcaccuggggaagcuggagauggacuucgacuucugcgacggcacgaccguggucgugaccgaggacugcgggaaccggggccccagccuccgcaccacgaccgccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucacggccggccacgggcaggucgacaacuucucccugggcgugcugggcauggcccucuuccuggaggagaugcugcggacccgcgucgggaccaagcacgcgauccuccugguggccgugagcuucgucacccugaucacgggcaacauguccuucaaggaccucgggcgggugguggucauggugggcgccaccaugaccgacgacaucgggaugggcgugaccuaccuggcccugcucgccgcguucaagguccgccccacguucgccgccggccuguuccugcggaagcucaccagcaaggagcugaugaugaccaccaucgggaucgugcugcucucccagagcacgcugcccgagaccauccuggagcucaccgacgcccuggcccugggcaugauggugcucaagaugguccgcgacauggagaaguaccagcuggcggugaccaucauggccauccugugcgucccgaacgccgugauccuccagaacgccuggaagguguccugcacgauccuggccgucgugagcgugagcccccugcuccugaccagcucccagcagaagaccgacuggaucccccuggcgcucaccaucaaggggcugaaccccacggccaucuuccugaccacccucagccgcaccaacaagaagcgguccuggccgcugaacgaggccaucauggccgucggcauggugagcauccuggcguccagccuccugaagaacgacauccccaugacgggcccccugguggccgggggccuccugaccgucugcuacgugcugaccgggcgcuccgccgaccucgagcuggagcgggccaccgacgugaagugggaggaccaggccgagaucagcggcagcucccccauccugagcaucacgaucuccgaggacgggagcauguccaucaagaacgaggaggaggagcagacccucaccauccugauccgcaccggccugcucgucaucagcggccuguucccgguguccauccccaucaccgcggccgccugguaccugugggaggugaagaagcagcgggccgggguccucugggacgugcccuccccgccgcccaugggcaaggccgagcuggaggacggggcguaccgcaucaagcagcggggcauccugggguacucccagaucggcgccggcguguacaaggaggggacguuccacaccauguggcacgucacccgcggcgccgugcucacccacaaggggaagcggaucgagcccagcugggccgacgugaagaaggaccugaucuccuacggcgggggcuggaagcuggagggcgaguggaaggagggggaggagguccaggugcucgcccuggagcccggcaagaacccccgcgcggugcagacgaagcccgggcuguucaagaccaacaccggcaccaucggggccgucagccucgacuucucccccggcacgagcggcucccccaucaucgacaagaaggggaagguggugggccuguacgggaacggcgucgugacccggagcggcgccuacguguccgccaucgcccagaccgagaaguccaucgaggacaaccccgacaucgaggacgacaucuuccgcaagcggcgccugaccaucauggaccugcaccccggggcgggcaagacgaagcgguaccuccccgccaucguccgcgaggccaucaagcgggggcugcgcacccugauccucgccccgacccgggugguggcggccgagauggaggaggcccugcgcggccugcccauccgguaccagacccccgccauccgcgccgagcacacggggcgcgagaucgucgaccucaugugccacgcgaccuucaccaugcggcugcugucccccgugcgcgugccgaacuacaaccucaucaucauggacgaggcccacuucaccgaccccgccagcaucgccgcccggggcuacaucagcacgcgcgucgagaugggcgaggcggccgggaucuucaugaccgccacgccgcccggcucccgggacccguucccccagagcaacgcccccaucaucgacgaggagcgcgagauccccgagcgguccuggaacagcgggcacgagugggugaccgacuucaagggcaagacggugugguucgucccguccaucaaggccgggaacgacaucgcggccugccugcgcaagaacggcaagaaggugauccagcugagccggaagaccuucgacuccgaguacgugaagacccgcaccaacgacugggacuucgucgugacgaccgacaucagcgagaugggcgccaacuucaaggccgagcgggugaucgacccccgccggugcaugaagcccgucauccucaccgacggggaggagcgcgugauccuggcgggccccaugccggugacccacuccagcgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgggagaaggucgacgcgaucgacggcgaguaccgccugcgcggggaggcccggaagaccuucguggaccucaugcgccggggcgaccugcccguguggcuggccuacaaggucgccgccgaggggaucaacuacgcggaccgccgguggugcuucgacggcaucaagaacaaccagauccucgaggagaacguggaggucgagaucuggaccaaggagggggagcgcaagaagcugaagccgcgguggcuggacgcccgcaucuacagcgacccccucgcccugaaggaguucaaggaguucgccgccggccggaagucccugacccucaaccugaucacggagaugggccgccugcccaccuucaugacccagaagacccgggacgcgcucgacaaccuggccgugcugcacacggccgaggccgggggccgcgcguacaaccacgcccucagcgagcugcccgagacccuggagacccuccugcugcucacccugcuggccaccgugaccggcgggaucuuccucuuccugauguccgggcgggggaucggcaagaugacccuggggaugugcugcaucgucaccgccagcauccuccugugguacgcccagauccagccgcacuggaucgcggccuccaucauccuggaguucuuccucaucgugcugcugauccccgagcccgagaagcagcgcacgccccaggacaaccagcucacguacguggucaucgccauccugaccgugguggccgccaccauggcgaacgagaugggcuuccuggagaagaccaagaaggaccucgggcugggcagcaucgccacgcagcagccggaguccaacauccuggacaucgaccuccggcccgccagcgccuggacccuguacgccgucgcgaccaccuucgugacgcccaugcugcgccacagcaucgagaacuccagcgugaacgucucccucaccgccaucgccaaccaggccaccgugcugaugggccuggggaagggcuggccccucagcaagauggacaucggggccccgcugcuggcgaucggcugcuacucccaggugaaccccaucacccucacggccgcccugcugcuccuggucgcccacuacgcgaucaucgggcccggccugcaggccaaggccacccgggaggcccagaagcgcgccgcggccggcaucaugaagaaccccaccguggacgggaucaccgugaucgaccucgacccgauccccuacgaccccaaguucgagaagcagcugggccaggucaugcugcucgugcugugcgugacgcagguccugaugaugcggaccaccugggcccucugcgaggcccugacccuggccacggggcccaucagcacccucugggagggcaacccggggcgcuucuggaacaccaccaucgcgguguccauggccaacaucuuccggggcagcuaccuggccggcgccgggcuccuguucuccaucaugaagaacacgaccaacagccgccgcggcaccgggaacaucggcgagacccugggcgagaaguggaagucccggcugaacgcccucggcaagagcgaguuccagaucuacaagaaguccggcauccaggagguggaccgcacgcuggcgaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggcccggccacgaggagcccaucccgauguccacguacggguggaaccucgugcggcugcagagcggcguggacgucuucuucaucccgcccgagaagugcgacacccugcucugcgacaucggggaguccagccccaacccgaccguggaggccggccgcacccugcgggugcugaaccucgucgagaacuggcugaacaacaacacccaguucugcaucaaggugcugaaccccuacaugcccagcgugaucgagaagauggagacgcugcagcgcaaguacggcggggcgcucguccggaacccgcugucccgcaacagcacccacgagauguacuggguguccaacgccagcggcaacaucguguccagcgucaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagccgugggacgugcugcccaccgucacccagauggcgaugacggacaccacccccuucgggcagcagcgcguguucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaagguccgguccaacgccgcccugggggccaucuucaccgacgagaacaaguggaaguccgcgcgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccugagcggcguggagggggagggccuccaccggcugggguacauccugcgcgacgucuccaagaaggagggcggcgccauguacgccgacgacacggccgggugggacacccggaucacccucgaggaccugaagaacgaggagauggugaccaaccacauggagggcgagcacaagaagcuggcggaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggagaucgccguccagaacuggcuggcccgcguggggcgggagcgccugagccggauggcgaucuccggcgacgacugcguggucaagccccucgacgaccgcuucgccagcgcccugacggcccugaacgacaugggcaagauccggaaggacauccagcagugggagccgucccgcggguggaacgacuggacccaggugcccuucugcagccaccacuuccacgagcucaucaugaaggacggccgggugcuggucgugcccugccgcaaccaggacgagcugaucgggcgggcccgcaucucccagggcgcgggguggagccuccgggagaccgccugccugggcaaguccuacgcccagauguggagccugauguacuuccaccgccgggaccuccgccuggccgccaacgcgaucugcuccgccgugcccagccacugggucccgaccucccggaccacguggagcauccacgccaagcacgaguggaugaccaccgaggacaugcugaccguguggaaccgcguguggauccaggagaaccccuggauggaggacaagacgcccgucgaguccugggaggagauccccuaccucggcaagcgggaggaccaguggugcgggagccugaucggccugaccagccgcgccaccugggccaagaacauccaggcggccaucaaccaggugcggucccucaucgggaacgaggaguacaccgacuacaugccgagcaugaagcgcuuccgccgggaggaggaggaggccggcgugcugugguga

SEQ ID NO: 9329 - RNA, 9876 nt, Artificial Sequence
  derived and/or modified CDS sequence (opt1) from DENV-2__FJ639829__SS-prME
agcgugggcaugaucaucaugcugauccccaccgugauggcguuccaccucaccacccgcaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacuccaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggccaagcugacgaacaccaccaccgagucccgcugccccacgcagggggagcccagccugaaggaggagcaggacaagcgguucgugugcaagcacuccaugguggaccgcggcuggggcaacgggugcggccucuucgggaagggcgggaucgugaccugcgccauguucacgugcaagaagaacauggagggcaagaucgugcagcccgagaaccuggaguacaccaucguggucacgccccacagcggcgaggagcacgccguggggaacgacaccggcaagcacgggaaggagaucaaggugaccccgcaguccagcaucaccgaggcggagcugaccggcuacgggacggucaccauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacgcuggucaccuucaagaacccccacgccaagaagcaggacguggucgugcucggcagccaggagggggccaugcacaccgcgcugaccggcgccacggagauccagauguccagcgggaaccuccuguucaccggccaccugaagugccggcugcgcauggacaagcuccagcugaagggcauguccuacagcaugugcaccgggaaguucaagguggucaaggagaucgccgagacccagcacggcacgaucgugauccgggugcaguacgagggggacggcucccccugcaagauccccuucgagaucauggaccuggagaagcgcuacguccucggccggcugaucaccgugaacccgaucgugaccgagaaggacagccccgucaacaucgaggccgagccgcccuucggggacuccuacaucaucaucggcguggagccggggcagcugaagcucaacugguucaagaagggcagcuccaucgggcagauguucgagaccacgaugcgcggcgccaagcgcauggcgauccugggcgacaccgccugggacuucgggagccugggcgggguguucaccuccaucggcaaggcccuccaccaggucuucggggccaucuacggcgccgcguucagcggcguguccuggaccaugaagauccugaucggggugaucaucacguggaucggcaugaacagccgguccaccagccuguccgucagccuggugcucgugggggucgugacccuguaccugggcgugaugguccaggccgacuccgggugcguggugagcuggaagaacaaggagcucaagugcggcagcggcaucuucaucaccgacaacguccacacguggaccgagcaguacaaguuccagcccgagucccccagcaagcuggccuccgccauccagaaggcgcaggaggaggggaucugcggcauccgcagcgugacccggcuggagaaccucauguggaagcagaucacccccgagcugaaccacauccuggccgagaacgaggugaagcucacgaucaugaccggggacaucaagggcaucaugcaggccgggaagcgcucccugcggccgcagcccaccgagcugaaguacagcuggaagaccuggggcaaggccaagaugcucuccacggagagccacaaccagaccuuccugaucgacggccccgagaccgccgagugcccgaacaccaaccgcgcguggaacucccuggaggucgaggacuacggguucggcguguucacgaccaacaucuggcucaagcugaaggagaagcaggacgccuucugcgacagcaagcugauguccgccgccaucaaggacaaccgggccgugcacgcggacaugggguacuggaucgagagcgcccucaacgacaccuggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgccggccccuggcaccuggggaagcuggagauggacuucgacuucugcgacggcacgaccgucguggugaccgaggacugcgggaaccggggccccagccuccgcaccacgaccgcgagcggcaagcugaucaccgaguggugcugccgguccugcacccugcccccgcuccgcuaccgcggggaggacggcugcugguacgggauggagauccgcccccugaaggagaaggaggagaaccuggucaacagccucgugacggccggccacgggcaggucgacaacuucucccugggcguccugggcauggcccucuuccuggaggagaugcugcggacccgcguggggaccaagcacgccauccuccugguggcggucagcuucgugacccugaucacgggcaacauguccuucaaggaccucgggcggguggucgugauggugggcgccaccaugaccgacgacaucgggaugggcgucaccuaccuggcccugcucgccgccuucaaggugcgccccacguucgcggccggccuguuccugcggaagcucaccagcaaggagcugaugaugaccaccaucgggaucgugcugcucucccagagcacgauccccgagaccauccuggagcugaccgacgcccucgcccugggcaugaugguccugaagauggugcgcgacauggagaaguaccagcucgccgucaccaucauggcgauccugugcgugccgaacgccgugauccugcagaacgccuggaaggucuccugcacgauccucgccguggugagcgucagcccccugcugcucaccagcucccagcagaagaccgacuggaucccccuggcccugaccaucaaggggcucaaccccacggcgaucuuccugaccacccugagccgcaccaacaagaagcgguccuggccgcucaacgaggccaucauggccgugggcauggugagcauccuggccuccagccugcucaagaacgacauccccaugacgggcccccuggucgccggcgggcugcucaccgugugcuacgugcugaccgggcgcuccgccgaccuggagcucgagcgggccaccgacgucaagugggaggaccaggccgagaucagcgggagcucccccauccugagcaucacgaucuccgaggacgggagcauguccaucaagaacgaggaggaggagcagacccugaccauccucauccgcaccggccugcuggugaucagcggccucuucccgguguccauccccaucaccgccgcggccugguaccugugggaggucaagaagcagcgggccggggugcugugggacgugcccuccccgccgcccaugggcaaggccgagcucgaggacggggccuaccgcaucaagcagcggggcauccugggguacucccagaucggcgcgggcgucuacaaggaggggacguuccacaccauguggcacgugacccgcggcgccgugcugacccacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucaucgacaagaaggggaagguggucggccucuacgggaacggcguggugacccggagcggcgccuacgucuccgccaucgcccagaccgagaaguccaucgaggacaaccccgacaucgaggacgacaucuuccgcaagcggcgccugaccaucauggaccugcaccccggggccggcaagacgaagcgguaccugcccgcgaucgugcgcgaggccaucaagcgggggcuccgcacccugauccuggccccgacccggguggucgccgcggagauggaggaggcccuccgcggccugcccauccgguaccagacccccgccauccgcgccgagcacacggggcgcgagaucguggaccugaugugccacgccaccuucaccaugcggcuccugucccccgugcgcgucccgaacuacaaccugaucaucauggacgaggcgcacuucaccgaccccgccagcaucgccgcccggggcuacaucagcacgcgcguggagaugggcgaggccgcggggaucuucaugaccgccacgccgcccggcucccgggacccguucccccagagcaacgcccccaucaucgacgaggagcgcgagauccccgagcgguccuggaacagcgggcacgagugggugaccgacuucaagggcaagacggucugguucgugccguccaucaaggccgggaacgacaucgccgcgugccuccgcaagaacggcaagaaggugauccagcugagccggaagaccuucgacuccgaguacgucaagacccgcaccaacgacugggacuucguggugacgaccgacaucagcgagaugggcgccaacuucaaggccgagcgggucaucgacccccgccggugcaugaagcccgugauccugaccgacggggaggagcgcgugauccucgccggccccaugccggucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgccaucgacggcgaguaccgccugcgcggggaggcgcggaagaccuucguggaccugaugcgccggggcgaccuccccgucuggcuggccuacaagguggccgccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucacggagaugggccgccugcccaccuucaugacccagaagacccgggacgcccuggacaaccucgcggugcugcacacggccgaggccgggggccgcgccuacaaccacgcgcugagcgagcuccccgagacccuggagacccugcuccugcugacccuccuggccaccgucaccgggggcaucuuccuguuccucauguccggccgggggaucggcaagaugacccuggggaugugcugcaucgugaccgccagcauccugcucugguacgcccagauccagccgcacuggaucgccgcguccaucauccuggaguucuuccugaucgugcuccugauccccgagcccgagaagcagcgcacgccccaggacaaccagcugacguacgucgugaucgccauccucaccguggucgccgccaccauggccaacgagaugggcuuccuggagaagaccaagaaggaccuggggcucggcagcaucgcgacgcagcagccggaguccaacauccuggacaucgaccugcggcccgccagcgccuggacccucuacgccguggccaccaccuucgugacgcccaugcugcgccacagcaucgagaacuccagcgucaacgugucccugaccgcgaucgccaaccaggccaccgugcucaugggccuggggaagggcuggccccugagcaagauggacaucggggccccgcuccuggccaucggcugcuacucccaggucaaccccaucacccugacggcggcccuccugcugcucguggcccacuacgccaucaucgggcccggccugcaggcgaaggccacccgggaggcccagaagcgcgccgccgcgggcaucaugaagaaccccaccguggacgggaucaccgucaucgaccuggacccgauccccuacgaccccaaguucgagaagcagcucggccaggugaugcugcuggugcucugcgucacccaggugcugaugaugcggaccaccugggcccugugcgaggcccucacccuggccacggggcccaucagcacccugugggagggcaacccggggcgcuucuggaacaccaccaucgccguguccauggcgaacaucuuccggggcagcuaccucgccggcgccgggcugcuguucuccaucaugaagaacacgaccaacagccgccgcggcaccgggaacaucggcgagacccucggcgagaaguggaagucccggcugaacgcccugggcaagagcgaguuccagaucuacaagaaguccggcauccaggaggucgaccgcacgcucgccaaggaggggaucaagcggggcgagaccgaccaccacgcggugagccgcggguccgccaagcugcggugguucguggagcgcaacauggucacccccgagggcaaggugguggaccugggcugcgggcggggcggguggagcuacuacugcggcgggcucaagaacguccgcgaggugaagggccugaccaagggcgggcccggccacgaggagcccaucccgauguccacguacggguggaaccuggugcggcuccagagcggcgucgacguguucuucaucccgcccgagaagugcgacacccugcugugcgacaucggggaguccagccccaacccgaccguggaggccggccgcacccuccggguccugaaccugguggagaacuggcucaacaacaacacccaguucugcaucaaggugcugaaccccuacaugcccagcgucaucgagaagauggagacgcugcagcgcaaguacggcggggcccuggugcggaacccgcucucccgcaacagcacccacgagauguacuggguguccaacgcgagcggcaacaucgucuccagcgugaacaugaucucccggaugcugaucaaccgcuucaccaugcggcacaagaaggccaccuacgagcccgacguggaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcugaccaagccgugggacguccuccccaccgugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagaccccgcgcaugugcacgcgggaggaguucacccgcaaggugcgguccaacgccgcccugggggccaucuucaccgacgagaacaaguggaaguccgcccgcgaggcggucgaggacucccgguucugggagcugguggacaaggagcgcaaccuccaccuggagggcaagugcgagaccugcguguacaacaugauggggaagcgggagaagaagcugggcgaguucgggaaggccaagggcagccgcgccaucugguacauguggcucggcgcccgguuccuggaguucgaggcccugggguuccucaacgaggaccacugguucucccgcgagaacagccugagcggcgucgagggggagggccugcaccggcucggguacauccugcgcgacguguccaagaaggagggcggcgcgauguacgccgacgacacggccgggugggacacccggaucacccuggaggaccucaagaacgaggagauggugaccaaccacauggagggcgagcacaagaagcuggccgaggcgaucuucaagcugacguaccagaacaaggucgugcgcgugcagcggcccacgccccgggggaccgucauggacaucaucagccggcgcgaccagcggggcuccggccagguggggaccuacggccucaacacguucaccaacauggaggcccagcugauccgccagauggagggggagggcguguucaagaacauccagcaccugaccgucaccgaggagaucgccgugcagaacuggcucgcccgcguggggcgggagcgccugagccggauggccaucuccggcgacgacugcgucgugaagccccuggacgaccgcuucgcgagcgcccucacggcccugaacgacaugggcaagauccggaaggacauccagcagugggagccgucccgcggguggaacgacuggacccaggugcccuucugcagccaccacuuccacgagcugaucaugaaggacggccggguccucguggugcccugccgcaaccaggacgagcugaucgggcgggcccgcaucucccagggcgccggguggagccugcgggagaccgcgugccucggcaaguccuacgcccagauguggagccugauguacuuccaccgccgggaccugcgccucgccgccaacgccaucugcuccgcgguccccagccacugggugccgaccucccggaccacguggagcauccacgccaagcacgaguggaugaccaccgaggacaugcugaccguguggaaccgcgucuggauccaggagaaccccuggauggaggacaagacgcccguggaguccugggaggagauccccuaccugggcaagcgggaggaccaguggugcgggagccucaucggccugaccagccgcgccaccugggccaagaacauccagguggccaucaaccagguccggucccugaucgggaacgaggaguacaccgacuacaugccgagcaugaagcgcuuccgccgggaggaggaggaggcgggcgugcucugguga

SEQ ID NO: 9330 - RNA, 9876 nt, Artificial Sequence
  derived and/or modified CDS sequence (opt1) from DENV-2__FJ639831__SS-prME
agcgcgggcaugaucaucaugcugauccccaccgugauggccuuccaccucaccacccgcaacggggagccccacaugaucgugagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaucguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcgugaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacccuggucacguucaagaacccccacgcgaagaagcaggacguggucgugcucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggucaaggagaucgccgagacccagcacggcaccaucgugauccgggugcaguacgagggggacggcucccccugcaagauccccuucgagaucauggaccuggagaagcgcuacguccucggccggcugaucacggugaacccgaucgugaccgagaaggacagccccgucaacaucgaggcggagccgcccuucggggacuccuacaucaucaucggcguggagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccaggucuucggggcgaucuacggcgccgccuucagcggcguguccuggaccaugaagauccugaucggggugaucaucaccuggaucggcaugaacagccgguccacgagccuguccgucagccuggugcucguggggaucgucacccuguaccugggcgugauggugcaggccgacuccgggugcgucgugagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgucacccggcuggagaaccucauguggaagcagaucacccccgagcugaaccacauccuggccgagaacgaggugaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccgagaccgccgagugcccgaacaccaaccgcgccuggaacucccuggagguggaggacuacggguucggcgucuucaccacgaacaucuggcucaagcugaaggagaagcaggacgccuucugcgacagcaagcugauguccgccgcgaucaaggacaaccgggccgugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgcgggccccgugucccagcacaacuaccgcccgggguaccacacccagaucgccggccccuggcaccuggggaagcuggagauggacuucgacuucugcgacggcaccacgguggucgugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucaccgccggccacgggcagaucgacaacuucucccugggcgugcugggcauggcccucuuccuggaggagaugcugcggacgcgcguggggaccaagcacgccauccuccuggucgccgugagcuucgugacccugaucaccggcaacauguccuucaaggaccucgggcgggucguggugauggucggcgccacgaugaccgacgacaucgggaugggcgugaccuaccuggcccugcucgcggccuucaaggugcgccccaccuucgucgccggccugcugcuccggaagcugacgagcaaggagcugaugaugaccaccaucgggaucgugcuccugucccagagcaccauccccgagacgauccuggagcucaccgacgcccuggcccugggcaugauggugcucaagaucguccgcgacauggagaaguaccagcuggcggugaccaucauggccauccugugcgucccgaacgccgugauccuccagaacgccuggaagguguccugcaccauccuggccgucgugagcgugagcccccugcuccugacgagcucccagcagaagaccgacuggaucccccuggcgcucaccaucaaggggcugaaccccaccgccaucuuccugacgacccucagccgcaccaacaagaagcgguccuggccgcugaacgaggccaucauggccgucggcauggugagcauccuggcguccagccuccugaagaacgacauccccaugaccggcccccugguggccgggggccuccugacggucugcuacgugcugaccgggcgcuccgccgaccucgagcuggagcgggccaccgacgugaagugggaggaccaggccgagaucagcggcagcucccccauccugagcaucaccaucuccgaggacgggagcauguccaucaagaacgaggaggaggagcagacgcucaccauccugauccgcaccggccugcucgucaucagcggccuguucccgguguccauccccaucaccgcggccgccugguaccugugggaggugaagaagcagcgggccgggguccucugggacgugcccuccccgccgcccaugggcaaggccgagcuggaggacggggcguaccgcaucaagcagaagggcgugcugggguacucccagaucggcgccggcgucuacaaggaggggaccuuccacacgauguggcacgugacccggggcgccgugcucaugcacaaggggaagcgcaucgagcccagcugggccgacgucaagaaggaccugaucuccuacggcgggggcuggaagcuggagggcgaguggaaggagggggaggagguccaggugcucgcccuggagcccggcaagaacccccgggcgguccagaccaagcccgggcuguucaagaccaacacgggcaccaucggggccgugagccucgacuucucccccggcaccagcggcucccccaucaucgacaagaaggggaagguggucggccuguacgggaacggcguggugacccgcagcggcgccuacgucuccgccaucgcccagacggagaaguccaucgaggacaaccccgacaucgaggacgacaucuuccggaagcgccggcugaccaucauggaccugcaccccggggcgggcaagaccaagcgcuaccuccccgccaucgugcgggaggccaucaagcgcgggcugcggacccugauccucgccccgacgcgcguggucgcggccgagauggaggaggcccugcggggccugcccauccgcuaccagacccccgccauccgggccgagcacaccgggcgcgagaucguggaccucaugugccacgcgaccuucacgaugcgccugcugucccccgugcgggucccgaacuacaaccucaucaucauggacgaggcccacuucaccgaccccgccagcaucgccgcccgcggcuacaucagcacccggguggagaugggcgaggcggccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcugagccgcaagaccuucgacuccgaguacgucaagacgcggaccaacgacugggacuucguggugaccaccgacaucagcgagaugggcgccaacuucaaggccgagcgcgucaucgacccccggcgcugcaugaagcccgugauccucacggacggggaggagcgggugauccuggcgggccccaugccggucacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccgcaagaccuucguggaccucaugcggcgcggcgaccugcccgucuggcuggccuacaagguggccgccgaggggaucaacuacgcggaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccgugcugcacaccgccgaggccgggggccgggcguacaaccacgcccucagcgagcugcccgagacccuggagacgcuccugcugcucacccugcuggccaccgucaccgggggcaucuuccucuuccugauguccggccgcgggaucggcaagaugacccuggggaugugcugcaucaucacggccagcauccuccugugguacgcccagauccagccgcacuggaucgcggccuccaucauccuggaguucuuccucaucgugcugcugauccccgagcccgagaagcagcggacgccccaggacaaccagcucaccuacguggucaucgccauccugaccgugguggccgccacgauggcgaacgagaugggcuuccuggagaagaccaagaaggaccucgggcugggcagcaucaccacccagcagccggaguccaacauccuggacaucgaccuccgccccgccagcgccuggacgcuguacgccgucgccaccaccuucgugacccccaugcugcggcacagcaucgagaacuccagcgugaacgucucccucacggcgaucgccaaccaggccaccgugcugaugggccuggggaagggcuggccccucagcaagauggacaucggggugccgcugcuggccaucggcugcuacucccaggucaaccccaucacccucaccgccgcgcugcugcuccugguggcccacuacgccaucaucgggcccggccugcaggccaaggcgacgcgcgaggcccagaagcgggccgccgccggcaucaugaagaaccccaccguggacgggaucaccgucaucgaccucgacccgauccccuacgaccccaaguucgagaagcagcugggccaggugaugcugcucgugcugugcgucacccaggugcugaugaugcgcacgaccugggcgaugugcgaggcccucacccuggccaccgggcccaucagcacgcugugggagggcaacccggggcgguucuggaacaccaccaucgccguguccauggccaacaucuuccgcggcagcuaccucgcgggcgccgggcugcuguucuccaucaugaagaacaccacgaacacccggcgcggcaccgggaacaucggcgagacccucggcgagaaguggaagucccgccugaacgcccuggggaaguccgaguuccagaucuacaagaaguccggcauccaggaggucgaccggacgcucgccaaggaggggaucaagcgcggcgagaccgaccaccacgccgugucccgggggagcgcgaagcugcgcugguucguggagcggaacauggucacccccgagggcaaggugguggaccugggcugcgggcgcggcgggugguccuacuacugcggcgggcucaagaacguccgggaggugaagggccugaccaagggcgggcccggccacgaggagcccaucccgaugagcacguacggguggaaccuggugcgccuccaguccggcgucgacguguucuucaucccgcccgagaagugcgacacccugcugugcgacaucggggagagcucccccaacccgaccguggaggccggccggacccuccgcguccugaaccugguggagaacuggcucaacaacaacacccaguucugcaucaaggugcugaaccccuacaugcccagcgucaucgagaagauggagacgcugcagcggaaguacggcggggcccuggugcgcaacccgcucagccggaacuccacccacgagauguacugggugagcaacgccuccggcaacaucgucagcuccgugaacaugaucagccgcaugcugaucaaccgguucaccaugcgccacaagaagaccacguacgagcccgacguggaccugggguccggcacccggaacaucgggaucgagagcgagauccccaaccucgacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggucaacggcguggugcggcugcugaccaagccgugggacguccuccccaccgugacgcagauggccaugaccgacaccacccccuucgggcagcagcgcguguucaaggagaaggucgacacgcgcacccaggagcccaaggagggcaccaagaagcugaugaagaucaccgccgaguggcuguggaaggagcucggcaagaagaagacgccgcggaugugcacccgcgaggaguucacccggaaggugcgcagcaacgccgcgcugggggccaucuucaccgacgagaacaaguggaaguccgcccgggaggccgucgaggacagccgcuucugggagcugguggacaaggagcggaagcuccaccuggagggcaagugcgagacgugcguguacaacaugauggggaagcgcgagaagaagcugggcgaguucgggaaggccaagggcucccgggcgaucugguacauguggcucggcgcccgcuuccuggaguucgaggcccugggguuccucaacgaggaccacugguucagccgggagaacucccugagcggcgucgagggggagggccugcacaagcucggguacauccugcgcgacgugagcaagaaggagggcggcgccauguacgccgacgacaccgcggggugggacacccggaucacccuggaggaccucaagaacgaggagauggugacgaaccacauggagggcgagcacaagaagcuggccgaggccaucuucaagcugaccuaccagaacaaggucgugcgcgugcagcggcccacgccccgggggaccgucauggacaucaucucccggcgcgaccagcggggcagcggccagguggggacguacggccucaacaccuucaccaacauggaggcccagcugauccgccagauggagggggagggcguguucaagaacauccagcaccugaccgucacggaggagaucgcggugcagaacuggcucgcccggguggggcgcgagcgccugucccggauggccaucagcggcgacgacugcgucgugaagccccuggacgaccgcuucgccuccgcccucaccgcgcugaacgacaugggcaagauccggaaggacauccagcagugggagccgagccgcggguggaacgacuggacccaggugcccuucugcucccaccacuuccacgagcugaucaugaaggacggccggguccucguggugcccugccgcaaccaggacgagcugaucgggcgggcccgcaucagccagggcgccggguggucccugcgggagaccgccugccucggcaagagcuacgcccagauguggucccugaucuacuuccaccgccgggaccugcgccucgcggccaacgccaucugcagcgccguccccucccacugggugccgaccagccggacgaccugguccauccacgccaagcacgaguggaugaccaccgaggacaugcugacgguguggaaccgcgucuggauccaggagaaccccuggauggaggacaagacccccguggagagcugggaggagauccccuaccugggcaagcgggaggaccaguggugcgggucccucaucggccugaccagccgcgcgaccugggccaagaacauccagacggccaucaaccaggugcggagccugaucgggaacgaggaguacaccgacuacaugccguccaugaagcgcuuccggcgcgaggaggaggaggccggcguccucugguga

SEQ ID NO: 9331 - RNA, 9876 nt, Artificial Sequence
  derived and/or modified CDS sequence (opt1) from DENV-2__FJ639832__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagguccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucagccggcgcgaccagcggggcuccggccagguggggaccuacggccugaacacguucaccaacauggaggcccagcugauccgccagauggagggggagggcgucuucaagaacauccagcaccucaccgugaccgaggagguggccguccagaacuggcuggcgcggguggggcgcgagcgccugagccggauggccaucuccggcgacgacugcguggucaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccggcgcgaggaggaggaggccggcgugcugugguga

SEQ ID NO: 9332 - RNA, 9876 nt, Artificial Sequence
  derived and/or modified CDS sequence (opt1) from DENV-2__FJ687434__SS-prME
agcgugggcaugaucaucaugcugauccccaccgucauggccuuccaccucaccacccgcaacggggagccccacaugaucguguccauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacuccaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggcccgccugacgaacaccaccaccgagucccggugccccacgcagggggagcccagccugaaggaggagcaggacaagcgcuucgugugcaagcacuccaugguggaccggggcuggggcaacgggugcggccucuucgggaagggcgggaucgugaccugcgccauguucacgugcaagaagaacauggagggcaagaucgugcagcccgagaaccuggaguacaccaucguggucacgccccacagcggcgaggagcacgccguggggaacgacaccggcaagcacgggaaggagaucaaggugaccccgcaguccagcaucaccgaggcggagcugaccggcuacgggacggucaccauggagugcagcccccggaccagccucgacuucaacgagauggugcugcugcagauggagaacaaggccuggcucgugcaccggcagugguuccuggaccugccccuccccuggcugccgggcgccgacacccagggcagcaacuggauccagaaggagacgcuggucaccuucaagaacccccacgccaagaagcaggacguggucgugcucgggucccaggagggcgccaugcacaccgcgcugaccggggccacggagauccagaugagcuccggcaaccugcuguucaccgggcaccugaagugccgccugcggauggacaagcuccagcugaagggcaugagcuacuccaugugcaccggcaaguucaagguggucaaggagaucgccgagacccagcacgggacgaucgugauccgcgugcaguacgagggcgacgggagccccugcaagauccccuucgagaucauggaccuggagaagcgguacguccucggccgccugaucaccgugaacccgaucgugaccgagaaggacucccccgucaacaucgaggccgagccgcccuucggcgacagcuacaucaucaucgggguggagccgggccagcugaagcucaacugguucaagaagggguccagcaucggccagauguucgagaccacgaugcgcggggccaagcggauggcgauccugggcgacaccgccugggacuucggcucccucggcgggguguucaccagcaucgggaaggcccuccaccaggucuucggggccaucuacggggccgcguucuccggcgugagcuggaccaugaagauccugaucggcgugaucaucacguggaucgggaugaacucccgcagcaccucccugagcgucucccuggugcucgugggcgucgugacccuguaccugggggugaugguccaggccgacagcggcugcguggugagcuggaagaacaaggagcucaagugcggguccggcaucuucaucaccgacaacguccacacguggaccgagcaguacaaguuccagcccgagagccccuccaagcuggccagcgccauccagaaggcgcaggaggagggcaucugcgggauccgguccgugacccgccuggagaaccucauguggaagcagaucacccccgagcugaaccacauccuggccgagaacgaggugaagcucacgaucaugaccggcgacaucaaggggaucaugcaggccggcaagcggagccugcgcccgcagcccaccgagcugaaguacuccuggaagaccugggggaaggccaagaugcucagcacggagucccacaaccagaccuuccugaucgacggccccgagaccgccgagugcccgaacaccaaccgggcguggaacagccuggaggucgaggacuacggcuucgggguguucacgaccaacaucuggcucaagcugaaggagaagcaggacgccuucugcgacuccaagcugaugagcgccgccaucaaggacaaccgcgccgugcacgcggacaugggcuacuggaucgaguccgcccucaacgacaccuggaagaucgagaaggccagcuucaucgaggucaagaacugccacuggcccaagucccacacccuguggagcaacggggugcuggaguccgagaugaucauccccaagaaccucgccggccccgugagccagcacaacuaccggccgggcuaccacacccagaucgccgggcccuggcaccugggcaagcuggagauggacuucgacuucugcgacgggacgaccgucguggugaccgaggacugcggcaaccgcgggcccagccuccggaccacgaccgcguccggcaagcugaucaccgaguggugcugccgcagcugcacccugcccccgcuccgguaccgcggcgaggacgggugcugguacggcauggagauccggccccugaaggagaaggaggagaaccuggucaacucccucgugacggccgggcacggccagguggacaacuucagccuggggguccugggcauggcccucuuccuggaggagaugcugcgcacccgggugggcaccaagcacgccauccuccugguggcggucuccuucgugacccugaucacggggaacaugagcuucaaggaccucggccgcguggucgugauggugggggccaccaugaccgacgacaucggcaugggggucaccuaccuggcccugcucgccgccuucaaggugcggcccacguucgcggccggccugcugcuccgcaagcugaccuccaaggagcugaugaugaccaccaucggcaucgugcuccugagccaguccacgauccccgagaccauccuggagcucaccgacgcccuggcccuggggaugaugguccucaagauggugcgcgacauggagaaguaccagcuggccgucaccaucauggcgauccugugcgugccgaacgccgugauccuccagaacgccuggaaggucagcugcacgauccuggccgugguguccgucagcccccugcuccugaccuccagccagcagaagaccgacuggaucccccuggcccucaccaucaagggccugaaccccacggcgaucuuccugaccacccucucccggaccaacaagaagcgcagcuggccgcugaacgaggccaucauggccguggggaugguguccauccuggccagcucccuccugaagaacgacauccccaugacgggcccccuggucgcgggcgggcuccugaccgugugcuacgugcugaccggccggagcgccgaccucgagcuggagcgcgccaccgacgucaagugggaggaccaggccgagaucagcggguccagccccauccuguccaucacgaucagcgaggacggcuccaugagcaucaagaacgaggaggaggagcagacccucaccauccugauccggaccgggcugcucgugaucuccggccuguucccggugagcauccccaucaccgccgcggccugguaccugugggaggucaagaagcagcgcgccggcgugcucugggacgugcccagcccgccgcccauggggaaggccgagcuggaggacggcgccuaccggaucaagcagcgcgggauccugggcuacagccagaucggggcgggcgucuacaaggagggcacguuccacaccauguggcacgugacccgcggggccgugcucaugcacaagggcaagcgcaucgagcccuccugggccgacgucaagaaggaccugaucagcuacgggggcggguggaagcuggagggcgaguggaaggagggcgaggagguccaggugcucgcccuggagcccgggaagaacccccgggccguccagaccaagcccggccuguucaagacgaacaccgggaccaucggcgcggugucccucgacuucagccccgggaccuccggcagccccaucaucgacaagaagggcaagguggucgggcuguacggcaacgggguggugacgcgcuccggcgccuacgucagcgccaucgcccagaccgagaaguccaucgaggacaaccccgacaucgaggacgacaucuuccggaagcgccggcugaccaucauggaccugcaccccggcgccgggaagaccaagcgcuaccuccccgcgaucgugcgggaggccaucaagcgcggccugcggacgcugauccucgccccgacccgcguggucgccgcggagauggaggaggcccugcgggggcugcccauccgcuaccagacccccgccauccgcgccgagcacaccggccgggagaucguggaccucaugugccacgccacguucaccaugcgccugcugagccccgugcgggucccgaacuacaaccucaucaucauggacgaggcgcacuucaccgaccccgccagcaucgccgcccgcggguacaucuccacccggguggagaugggcgaggccgcgggcaucuucaugacggccacgccgcccgggagccgcgacccguucccccaguccaacgcccccaucaucgacgaggagcgggagauccccgagcgcagcuggaacuccggccacgagugggugaccgacuucaaggggaagaccgucugguucgugccgagcaucaaggccggcaacgacaucgccgcgugccugcggaagaacgggaagaaggugauccagcugucccgcaagacguucgacagcgaguacgucaagacccggaccaacgacugggacuucguggugaccacggacaucuccgagaugggcgccaacuucaaggccgagcgcgucaucgacccccggcgcugcaugaagcccgugauccucaccgacggcgaggagcgggugauccuggccgggcccaugccggucacccacagcuccgcggcccagcgccggggccgcaucgggcggaaccccaagaacgagaacgaccaguacaucuacaugggcgagccccuggagaacgacgaggacugcgcccacuggaaggaggccaagaugcuccuggacaacaucaacacccccgaggggaucaucccgagcauguucgagcccgagcgcgagaagguggacgccaucgacggcgaguaccgccugcggggcgaggcgcgcaagacguucguggaccucaugcggcgcggggaccugcccgucuggcuggccuacaagguggccgccgagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcgcggaucuacuccgacccccucgcccugaaggaguucaaggaguucgccgccgggcgcaagagccugacccucaaccugaucaccgagaugggccggcugcccacguucaugacccagaagacccgcgacgcccucgacaaccuggcggugcugcacaccgccgaggccggcgggcgggccuacaaccacgcgcucuccgagcugcccgagacgcuggagacccuccugcugcucacccugcuggccaccgucaccggcgggaucuuccucuuccugaugagcggccgcggcaucgggaagaugacgcugggcaugugcugcaucgugaccgccuccauccuccugugguacgcccagauccagccgcacuggaucgccgcgagcaucauccuggaguucuuccucaucgugcugcugauccccgagcccgagaagcagcggacgccccaggacaaccagcucaccuacgucgugaucgccauccugacgguggucgccgccaccauggccaacgagaugggguuccuggagaagaccaagaaggaccucggccugggguccaucgcgacccagcagccggagagcaacauccuggacaucgaccuccgccccgccagcgccuggacgcuguacgccguggccaccaccuucgugacccccaugcugcggcacuccaucgagaacagcuccgucaacgugagccucacggcgaucgccaaccaggccaccgugcugaugggccugggcaagggguggccccucuccaagauggacaucggcgccccgcugcuggccaucgggugcuacagccaggucaaccccaucacccucaccgcggcccugcugcuccugguggcccacuacgccaucaucggccccgggcugcaggcgaaggccacgcgcgaggcccagaagcgggccgccgcgggcaucaugaagaaccccaccguggacggcaucaccgucaucgaccucgacccgauccccuacgaccccaaguucgagaagcagcuggggcaggccaugcugcucgugcugugcgugacccagguccugaugaugcgcacgaccugggcccucugcgaggcccugacccuggccaccggccccaucuccacgcucugggaggggaacccgggccgguucuggaacaccaccaucgcggugagcauggccaacaucuuccgcggguccuaccuggccggcgccggccuccuguucagcaucaugaagaacaccacgaacucccgccgggggaccggcaacaucggggagacccugggcgagaaguggaagucccgccugaacgcccucggcaaguccgaguuccagaucuacaagaaguccgggauccaggagguggaccggacccuggcgaaggagggcaucaagcgcggggagacggaccaccacgccgucucccggggcagcgccaagcugcgcugguucguggagcggaacauggugacccccgaggggaaggucguggaccucggcugcggccgcgggggcugguccuacuacugcgggggccugaagaacgugcgggaggucaaggggcugaccaagggcggccccgggcacgaggagcccaucccgaugagcaccuacggcuggaaccucgugcgccugcaguccgggguggacgucuucuucaucccgcccgagaagugcgacacgcugcucugcgacaucggcgagagcagccccaacccgaccguggaggccgggcggacccugcgcgugcugaaccucgucgagaacuggcugaacaacaacacccaguucugcaucaaggugcugaaccccuacaugcccuccgugaucgagaagauggagacccugcagcggaaguacggcggcgcgcucguccgcaacccgcugagccggaacuccacgcacgagauguacugggugagcaacgccuccgggaacaucgugagcuccgucaacaugaucagccgcaugcugaucaaccgguucaccaugcgccacaagaaggccaccuacgagcccgacguggaccucggcuccgggacccggaacaucggcaucgagagcgagauccccaaccuggacaucaucgggaagcgcaucgagaagaucaagcaggagcacgagacguccuggcacuacgaccaggaccaccccuacaagaccugggccuaccacggcagcuacgagaccaagcagaccggcuccgccagcuccauggugaacggggucgugcgccugcucacgaagccgugggacgugcugcccaccgucacccagauggcgaugaccgacacgacccccuucggccagcagcggguguucaaggagaagguggacacccgcacccaggagcccaaggaggggacgaagaagcugaugaagaucaccgccgaguggcucuggaaggagcugggcaagaagaagaccccgcggaugugcacccgcgaggaguucacgcggaagguccgcagcaacgccgcccugggcgccaucuucaccgacgagaacaaguggaaguccgcgcgggaggccguggaggacagccgcuucugggagcucgucgacaaggagcggaaccugcaccuggaggggaagugcgagaccugcguguacaacaugaugggcaagcgcgagaagaagcucggggaguucggcaaggccaaggggucccgggccaucugguacauguggcugggcgcccgcuuccuggaguucgaggcgcucggcuuccugaacgaggaccacugguucagccgggagaacagccuguccgggguggagggcgaggggcuccacaagcugggcuacauccugcgcgacgucagcaagaaggagggcggggccauguacgccgacgacaccgccggcugggacacgcggaucacccucgaggaccugaagaacgaggagauggugaccaaccacauggagggggagcacaagaagcuggcggaggccaucuucaagcucaccuaccagaacaaggugguccgcgugcagcggcccacgccccgcggcaccgugauggacaucaucucccggcgcgaccagcgggggagcggccaggucgggaccuacggccugaacaccuucacgaacauggaggcccagcugauccgccagauggagggcgaggggguguucaagaacauccagcaccucaccgugaccgaggagaucgccguccagaacuggcuggcccgcgugggccgggagcgccugucccggauggcgaucagcggggacgacugcguggucaagccccucgacgaccgcuucgccuccgcccugaccgcccugaacgacaugggcaagauccggaaggacauccagcagugggagccgagccgcggcuggaacgacuggacccaggugcccuucugcucccaccacuuccacgagcucaucaugaaggacgggcgggugcuggucgugcccugccgcaaccaggacgagcugaucggccgggcccgcaucagccagggggcgggcuggucccuccgggagaccgccugccugggcaagagcuacgcccagauguggucccugauguacuuccaccgccgggaccuccgccuggccgccaacgcgaucugcagcgccgugcccucccacugggucccgaccagccggaccaccugguccauccacgccaagcacgaguggaugacgaccgaggacaugcugaccguguggaaccgcguguggauccaggagaaccccuggauggaggacaagacccccgucgagagcugggaggagauccccuaccucggcaagcgggaggaccaguggugcggcagccugaucgggcugacgucccgcgccaccugggccaagaacauccaggcggccaucaaccaggugcggagccucaucggcaacgaggaguacaccgacuacaugccguccaugaagcgcuuccgccgggaggaggaggaggccggggugcugugguga

SEQ ID NO: 9333 - RNA, 9876 nt, Artificial Sequence
  derived and/or modified CDS sequence (opt1) from DENV-2__FJ687439__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcggccuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgcgaagaagcaggacgucgugguccucggcagccaggagggggccaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgcgacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgccaagcgcauggccauccugggcgacaccgccugggacuucgggucccugggcggggucuucacgagcaucggcaaggcgcuccaccagguguucggggccaucuacggcgccgccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggcggacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggcggggaagcgcagccugcggccgcagcccacggagcugaaguacuccuggaagaccuggggcaaggccaagaugcucagcaccgaguccuacaaccagaccuuccugaucgacggccccgagacggccgagugcccgaacaccaaccgcgccuggaacagccuggaggucgaggacuacggguucggcguguucaccaccaacaucuggcucaagcugaaggagaagcaggacgccuucugcgacuccaagcugaugagcgcggccaucaaggacaaccgggccgugcacgccgacaugggguacuggaucgaguccgcccucaacgacacguggaagaucgagaaggcgagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgccggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgcgggccacggccagguggacaacuucagccugggcgugcugggcauggcccucuuccuggaggagaugcugcggacccgcgucgggacgaagcacgccauccuccugguggccguguccuucgucacccugaucaccggcaacaugagcuucaaggaccucgggcgggugguggucauggugggcgccaccauggcggacgacaucgggaugggcgugacguaccuggcccugcucgccgccuucaagguccgccccaccuucgccgcgggccugcugcuccggaagcugaccuccaaggagcugaugaugaccacgaucgggaucgugcuccugagccaguccaccauccccgagaccauccuggagcucaccgacgcccuggcccugggcaugauggugcucaagaucguccgcaacauggagaaguaccagcuggccgugacgaucauggccauccugugcgugccgaacgcggucauccuccagaacgccuggaaggugagcugcaccauccuggccgucguguccgugagcccccugcuccugaccuccagccagcagaagaccgacuggaucccccuggcccucacgaucaaggggcugaaccccaccgcgaucuuccugaccacccucucccgcacgaacaagaagcggagcuggccgcugaacgaggccaucauggccgucggcaugguguccauccuggccagcucccuccugaagaacgacauccccaugaccggcccccugguggccgggggccuccugaccgucugcuacgugcugaccgggcgcagcgcggaccucgagcuggagcgggccacggacgugaagugggaggaccaggccgagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgcgugguaccugugggaggugaagaagcagcgggccggggugcucugggacguccccagcccgccgcccaugggcaaggccgagcuggaggacggggccuaccgcaucaagcagaagggcauccugggguacagccagaucggcgccggcguguacaaggaggggaccuuccacaccauguggcacgugacccggggcgcgguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgcguacgugagcgccaucgcccagaccgagaaguccaucgaggacaaccccgagaucgaggacgacaucuuccggaagcgccggcugaccaucauggaccugcaccccggggccggcaagacgaagcgcuaccuccccgcgaucgugcgggaggccaucaagcgcgggcugcggacccugauccucgccccgacccgcgucguggccgccgagauggaggaggcgcugcggggccugcccauccgcuaccagacccccgccauccgggccgagcacacggggcgcgagaucguggaccucaugugccacgccaccuucaccaugcgccugcugagccccguccgggugccgaacuacaaccucaucgugauggacgaggcccacuucaccgaccccgcguccaucgccgcccgcggcuacaucagcacgcgggucgagaugggcgaggccgccgggaucuucaugaccgcgacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggccgggaacgacaucgccgcgugccugcggaagaacggcaagaaggugauccagcugucccgcaagaccuucgacagcgaguacgugaagacccggaccaacgacugggacuucgucgugacgaccgacaucuccgagaugggcgccaacuucaaggccgagcgcgugaucgacccccggcgcugcaugaagcccgucauccucaccgacggggaggagcgggugauccuggccggccccaugccggugacccacagcuccgccgcgcagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggcguacaaggucgccgccgaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcgcugaaggaguucaaggaguucgccgccggccgcaagagccugacccucaaccugaucacggagaugggccggcugcccaccuucaugacccagaagacccgcgacgcccucgacaaccuggcgguccugcacacggccgaggccgggggccgggccuacaaccacgcccucuccgagcugcccgagacccuggagacccuccugcugcucacccugcuggcgacggugaccgggggcaucuuccucuuccugaugagcggccgcgggaucggcaagaugacccuggggaugugcugcaucaucaccgccuccauccuccugugguacgcccagauccagccgcacuggaucgccgccagcaucauccuggaguucuuccucaucguccugcugauccccgagcccgagaagcagcggacgccccaggacaaccagcucacguacguggugaucgcgauccugaccgucguggccgccaccauggccaacgagaugggcuuccuggagaagaccaagaaggaccucgggcugggcuccaucgccacgcagcagccggagagcaacauccuggacaucgaccuccgccccgcguccgccuggacccuguacgccguggccaccaccuucgucacgcccaugcugcggcacagcaucgagaacagcuccgugaacaucagccucaccgccaucgcgaaccaggccaccgugcugaugggccuggggaagggcuggccccucuccaagauggacaucggggucccgcugcuggccaucggcugcuacagccaggugaaccccaucacccucacggccgcgcugcugcuccugguggcccacuacgccaucaucgggcccggccugcaggccaaggccacccgcgaggcgcagaagcgggccgccgccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcgcugacccuggccacggggcccaucuccacccucugggagggcaacccggggcgguucuggaacaccaccaucgccgugagcauggccaacaucuuccgcggcuccuaccuggccggcgcggggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggccaaggaggggaucaagcgcggcgagaccgaccaccacgccgugagccggggguccgcgaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcccugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggcgaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgcggcccugggggccaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggcgaagggcagccgggccaucugguacauguggcugggcgcccgcuuccuggaguucgaggcccucggguuccugaacgaggaccacugguucucccgggagaacagccuguccggcguggagggggagggccuccacaagcugggguacauccugcgcgacgucagcaagaaggagggcggcgcgauguacgccgacgacacggccgggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcgcagcugauccgccagauggagggggagggcguguucaagaacauccagcaccucaccgucaccgaggagguggccgugcagaacuggcuggcccgggucgggcgcgagcgccugagccggauggccaucuccggcgacgacugcguggugaagccccucgacgaccgcuucgccaacgcgcugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgccggguggucccuccgcgagaccgccugccugggcaagagcuacgcgcagauguggucccugauguacuuccaccggcgcgaccuccggcuggccgccaacgccaucugcagcgccgugcccucccacugggugccgaccagccgcacgaccugguccauccacgcgaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggccaagaacauccaggccgcgaucaaccagguccggucccucaucgggaacgaggaguacaccgacuacaugccgagcaugaagcgcuuccggcgcgaggaggaggaggccggcgugcugugguga

SEQ ID NO: 9334 - RNA, 9876 nt, Artificial Sequence
  derived and/or modified CDS sequence (opt1) from DENV-2__FJ687440__SS-prME
agcgccggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccuggaucaccuacgggaccugcaccaccaccggcgagcaccgccgggagaagcgcagcguggcccuggucccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcgcccucaucuucauccugcugacggccguggcgcccuccaugaccaugcggugcaucggcaucagcaaccgcgacuucgucgagggcguguccgggggcagcuggguggacaucguccucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcgggcuguucggcaagggcgggaucgugacgugcgcgauguucacgugcaagaagaacauggagggcaagaucgugcagcccgagaaccuggaguacaccaucgucgugacgccccacuccggggaggagcacgccgugggcaacgacacggggaagcacggcaaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcagggcuccaacuggauccagaaggagacccuggugaccuucaagaacccccacgcgaagaagcaggacguggucgugcucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaaggucgugaaggagaucgccgagacccagcacgggaccaucgugauccggguccaguacgagggcgacggcagccccugcaagauccccuucgagaucauggaccuggagaagcgcuacgugcucgggcggcugaucaccgugaacccgaucgucacggagaaggacucccccgugaacaucgaggcggagccgcccuucggcgacagcuacaucaucaucgggguggagccgggccagcugaagcucaacugguucaagaagggguccagcaucggccagauguucgagaccaccaugcgcggcgccaagcgcauggccauccugggggacaccgccugggacuucggcucccucggcggggucuucacgagcaucgggaaggcccuccaccagguguucggcgcgaucuacggcgccgccuucuccggggugagcuggaccaugaagauccugaucggcgucaucaucaccuggaucgggaugaacucccggagcaccucccugagcgugucccuggugcucgucggcaucgugacgcuguaccugggggugaugguccaggccgacagcggcugcgugguguccuggaagaacaaggagcucaagugcggcagcgggaucuucaucaccgacaacguccacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggaggucgaggacuacggcuucgggguguucaccaccaacaucuggcucaagcugaaggagaagcaggacgccuucugcgacuccaagcugaugagcgccgcgaucaaggacaaccgggccgugcacgccgacaugggcuacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgcggggcccgugagccagcacaacuaccgcccgggcuaccacacccagaucgccgggcccuggcaccugggcaagcuggagauggacuucgacuucugcgacgggaccaccgucaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggugaacucccucgucaccgccgggcacggccagguggacaacuucagccugggcgugcuggggauggcccuguuccuggaggagaugcugcggacccgcgucggcacgaagcacgccauccuccugguggccguguccuucgucacccugaucaccgggaacaugagcuucaaggaccucggccgggugguggucauggugggggccaccaugacggacgacaucggcaugggcgugaccuaccuggcccugcucgcggccuucaagguccgccccaccuucgccgccgggcugcugcuccggaagcugaccuccaaggagcugaugaugacgaccaucggcaucgugcuccugagccaguccaccauccccgagaccauccuggagcucacggacgcccuggcgcuggggaugauggugcucaagaucguccgcaacauggagaaguaccagcuggccgugaccaucauggccauccugugcgugccgaacgccgucauccuccagaacgccuggaaggugagcugcaccauccuggcggucguguccgugagcccccugcuccugaccuccagccagcagaagacggacuggaucccccuggcccucaccaucaagggccugaaccccaccgccaucuuccugaccacgcucucccgcaccaacaagaagcggagcuggccgcugaacgaggccaucauggcggucggcaugguguccauccuggccagcucccuccugaagaacgacauccccaugaccgggccccugguggccggcgggcuccugaccgucugcuacgugcugacgggccgcagcgccgaccucgagcuggagcgggccaccgacgugaagugggaggaccaggcggagaucuccgggagcagccccauccuguccaucaccaucagcgaggacggcuccaugagcaucaagaacgaggaggaggagcagacccucacgauccugauccgcaccggccugcucgucaucuccgggcuguucccggugagcauccccaucaccgccgccgccugguaccugugggaggugaagaagcagcgggccggcguccucugggacgugcccagcccgccgcccauggggaaggcggagcuggaggacggcgccuaccgcaucaagcagaaggggauccugggcuacagccagaucggcgccgggguguacaaggagggcaccuuccacaccauguggcacgucacgcgcggggcggugcucaugcacaagggcaagcgcaucgagcccuccugggccgacgugaagaaggaccugaucagcuacgggggcggcuggaagcuggagggggaguggaaggagggcgaggagguccaggugcucgcgcuggagcccgggaagaacccccgggccgugcagaccaagcccggccuguucaagaccaacaccgggacgaucggcgccgucucccucgacuucagccccggcaccuccgggagccccaucaucgacaagaagggcaaggugguggggcuguacggcaacggcgucgugacccgcuccggggccuacgugagcgccaucgcgcagaccgagaaguccaucgaggacaaccccgagaucgaggacgacaucuuccggaagcgccggcugacgaucauggaccugcaccccggcgccgggaagaccaagcgcuaccuccccgccaucguccgggaggccaucaagcgcggccugcggacccugauccucgcgccgacccgcgugguggccgccgagauggaggaggcccugcgggggcugcccauccgcuaccagacgcccgccauccgggcggagcacaccggccgcgagaucgucgaccucaugugccacgccaccuucaccaugcgccugcugagccccgugcgggugccgaacuacaaccucaucaucauggacgaggcccacuucacggaccccgccuccaucgccgcgcgcggcuacaucagcacccgggucgagaugggggaggccgccggcaucuucaugaccgccacgccgcccgggagccgcgacccguucccccaguccaacgcccccaucaucgacgaggagcgggagauccccgagcgcagcuggaacuccggccacgagugggugacggacuucaccgggaagaccgugugguucgucccgagcaucaaggcgggcaacgacaucgccgccugccugcggaagaacggcaagaaggugauccagcugucccgcaagaccuucgacagcgaguacgugaagacgcggaccaacgacugggacuucgucgugaccaccgacaucuccgagaugggggccaacuucaaggcggagcgcgugaucgacccccggcgcugcaugaagcccgucauccucacggacggcgaggagcgggugauccuggccgggcccaugccggugacccacagcuccgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgcgagaaggucgacgccaucgacggggaguaccggcugcgcggcgaggcccgcaagaccuucguggaccucaugcggcgcggggaccugcccguguggcuggccuacaaggucgccgcggagggcaucaacuacgccgaccggcgcuggugcuucgacgggaucaagaacaaccagauccucgaggagaacguggagguggagaucuggacgaaggagggcgagcggaagaagcugaagccgcgcuggcuggacgcccggaucuacuccgacccccucgcccugaaggaguucaaggaguucgccgcgggccgcaagagccugacccucaaccugaucaccgagauggggcggcugcccaccuucaugacgcagaagacccgcgacgcccucgacaaccuggccguccugcacaccgccgaggcgggcgggcgggccuacaaccacgcccucuccgagcugcccgagacccuggagacgcuccugcugcucacccugcuggccaccgugaccggcggcaucuuccucuuccugaugagcgggcgcggcaucgggaagaugacccugggcaugugcugcaucaucacggccuccauccuccugugguacgcgcagauccagccgcacuggaucgccgccagcaucauccuggaguucuuccucaucguccugcugauccccgagcccgagaagcagcggacgccccaggacaaccagcucaccuacguggugaucgccauccugaccgucguggccgcgacgauggccaacgagaugggguuccuggagaagaccaagaaggaccucggccugggcuccaucgccacccagcagccggagagcaacauccuggacaucgaccuccgccccgccuccgccuggacccuguacgcgguggccacgaccuucgucacccccaugcugcggcacagcaucgagaacagcuccgugaacgugagccucaccgccaucgccaaccaggccacgguccugauggggcugggcaagggguggccccucuccaagauggacaucggcgugccgcugcuggcgaucgggugcuacagccaggugaaccccaucacccucaccgccgcccugcugcuccuggucgcccacuacgcgaucaucggccccggccugcaggccaaggccacccgcgaggcccagaagcgggccgcggccgggaucaugaagaaccccacgguggacggcaucaccgugaucgaccucgacccgauccccuacgaccccaaguucgagaagcagcuggggcaggucaugcugcucauccugugcgugacccaggugcugaugaugcgcaccacgugggcccucugcgaggcccugacccuggccaccggccccaucuccacccucugggaggggaacccgggccgguucuggaacacgaccaucgcggucagcauggccaacaucuuccgcggcuccuaccuggccggggccggccuccucuucagcaucaugaagaacaccaccaacacgcggcgcgggaccggcaacaucggcgagacccugggggagaaguggaagucccgccugaacgcccucggcaagagcgaguuccagaucuacaagaaguccgggauccaggagguggaccggacccuggcgaaggagggcaucaagcgcggggagacggaccaccacgccgugagccggggcuccgccaagcugcgcugguucgucgagcggaacauggugacccccgagggcaagguggucgaccucgggugcggccgcgggggcuggagcuacuacugcgggggccugaagaacgugcgggaggugaagggccugaccaagggcggccccgggcacgaggagcccaucccgauguccaccuacggcuggaaccucguccgccugcagagcgggguggacguguucuucaucccgcccgagaagugcgacacgcugcucugcgacaucggcgaguccagccccaacccgaccgucgaggccggccggacccugcgcgugcugaaccucguggagaacuggcugaacaacaacacccaguucugcaucaagguccugaaccccuacaugcccuccgugaucgagaagauggaggcgcugcagcggaaguacgggggcgcccucgugcgcaacccgcugagccggaacagcacccacgagauguacugggucuccaacgccagcgggaacaucguguccagcgugaacaugaucucccgcaugcugaucaaccgguucacgaugcgccacaagaaggccaccuacgagcccgacgucgaccucggcagcgggacccggaacaucggcaucgaguccgagauccccaaccuggacaucaucggcaagcgcaucgagaagaucaagcaggagcacgagaccagcuggcacuacgaccaggaccaccccuacaagacgugggccuaccacggguccuacgagaccaagcagaccggcagcgcguccagcauggugaacggggugguccggcugcucaccaagccgugggacgugcugcccacggugacccagauggccaugaccgacaccacgcccuucggccagcagcgcgucuucaaggagaagguggacacccgcacccaggagcccaaggagggcaccaagaagcugaugaagaucacggccgaguggcucuggaaggagcuggggaagaagaagaccccgcggaugugcacccgcgaggaguucacccggaaggugcgcuccaacgccgcccugggcgcgaucuucacggacgagaacaaguggaaguccgcccgggaggccgucgaggacucccgcuucugggagcucguggacaaggagcggaaccugcaccuggaggggaagugcgagaccugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgccgacgacaccgcgggcugggacacccggaucacgcucgaggaccugaagaacgaggagauggucaccaaccacauggagggggagcacaagaagcuggccgaggccaucuucaagcucaccuaccagaacaagguggugcgcguccagcggcccacgccccggggcacggugauggacaucaucagccggcgcgaccagcggggguccggccaggugggcaccuacgggcugaacaccuucaccaacauggaggcccagcugauccgccagauggagggcgagggggucuucaagaacauccagcaccucacggccaccgaggagaucgcggugcagaacuggcuggcccgggugggccgcgagcgccugagccggauggccaucuccggcgacgacugcgucgugaagccccucgacgaccgcuucgccaacgcccugaccgcgcugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccuccgcgagacggccugccugggcaagagcuacgcccagauguggucccugauguacuuccaccggcgcgaccuccggcuggcggccaacgccaucugcagcgccguccccucccacugggugccgaccagccgcaccaccugguccauccacgccaagcacgaguggaugaccacggaggacaugcugaccguguggaaccgggucuggauccgcgagaaccccuggauggaggacaagacccccguggagagcugggaggagauccccuaccucgggaagcgggaggaccaguggugcggcucccugaucgggcugaccagccgcgcgacgugggccaagaacauccaggccgccaucaaccaggugcggucccucaucggcaacgaggaguacaccgacuacaugccgagcaugaagcgcuuccggcgcgaggaggaggaggcggggguccugugguga

SEQ ID NO: 9335 - RNA, 9876 nt, Artificial Sequence
  derived and/or modified CDS sequence (opt1) from DENV-2__FJ687441__SS-prME
agcgccggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccuggaucaccuacgggaccugcaccaccaccggcgagcaccgccgggagaagcgcagcguggcccuggucccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccguggcgcccuccaugaccaugcggugcaucggcaucagcaaccgcgacuucgucgagggcguguccgggggcagcuggguggacaucguccucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcgggcuguucggcaagggcgggaucgugacgugcgcgauguucacgugcaagaagaacauggagggcaagaucgugcagcccgagaaccuggaguacaccaucgucgugacgccccacuccggggaggagcacgccgugggcaacgacacggggaagcacggcaaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcagggcuccaacuggauccagaaggagacccuggugaccuucaagaacccccacgcgaagaagcaggacguggucgugcucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaaggucgugaaggagaucgccgagacccagcacgggaccaucgugauccggguccaguacgagggcgacggcagccccugcaagauccccuucgagaucauggaccuggagaagcgcuacgugcucgggcggcugaucaccgugaacccgaucgucacggagaaggacucccccgugaacaucgaggcggagccgcccuucggcgacagcuacaucaucaucgggguggagccgggccagcugaagcucaacugguucaagaagggguccagcaucggccagauguucgagaccaccaugcgcggcgccaagcgcauggccauccugggggacaccgccugggacuucggcucccucggcggggucuucacgagcaucgggaaggcccuccaccagguguucggcgcgaucuacggcgccgccuucuccggggugagcuggaccaugaagauccugaucggcgucaucaucaccuggaucgggaugaacucccggagcaccucccugagcgugucccuggugcucgucggcaucgugacgcuguaccugggggugaugguccaggccgacagcggcugcgugguguccuggaagaacaaggagcucaagugcggcagcgggaucuucaucaccgacaacguccacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggaggucgaggacuacggcuucgggguguucaccaccaacaucuggcucaagcugaaggagaagcaggacgccuucugcgacuccaagcugaugagcgccgcgaucaaggacaaccgggccgugcacgccgacaugggcuacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgcggggcccgugagccagcacaacuaccgcccgggcuaccacacccagaucgccgggcccuggcaccugggcaagcuggagauggacuucgacuucugcgacgggaccaccgucaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggugaacucccucgucaccgccgggcacggccagguggacaacuucagccugggcgugcuggggauggcccuguuccuggaggagaugcugcggacccgcgucggcacgaagcacgccauccuccugguggccguguccuucgucacccugaucaccgggaacaugagcuucaaggaccucggccgggugguggucauggugggggccaccaugacggacgacaucggcaugggcgugaccuaccuggcccugcucgcggccuucaagguccgccccaccuucgccgccgggcugcugcuccggaagcugaccuccaaggagcugaugaugacgaccaucggcaucgugcuccugagccaguccaccauccccgagaccauccuggagcucacggacgcccuggcgcuggggaugauggugcucaagaucguccgcaacauggagaaguaccagcuggccgugaccaucauggccauccugugcgugccgaacgccgucauccuccagaacgccuggaaggugagcugcaccauccuggcggucguguccgugagcccccugcuccugaccuccagccagcagaagacggacuggaucccccuggcccucaccaucaagggccugaaccccaccgccaucuuccugaccacgcucucccgcaccaacaagaagcggagcuggccgcugaacgaggccaucauggcggucggcaugguguccauccuggccagcucccuccugaagaacgacauccccaugaccgggccccugguggccggcgggcuccugaccgucugcuacgugcugacgggccgcagcgccgaccucgagcuggagcgggccaccgacgugaagugggaggaccaggcggagaucuccgggagcagccccauccuguccaucaccaucagcgaggacggcuccaugagcaucaagaacgaggaggaggagcagacccucacgauccugauccgcaccggccugcucgucaucuccgggcuguucccggugagcauccccaucaccgccgccgccugguaccugugggaggugaagaagcagcgggccggcguccucugggacgugcccagcccgccgcccauggggaaggcggagcuggaggacggcgccuaccgcaucaagcagaaggggauccugggcuacagccagaucggcgccgggguguacaaggagggcaccuuccacaccauguggcacgucacgcgcggggcggugcucaugcacaagggcaagcgcaucgagcccuccugggccgacgugaagaaggaccugaucagcuacgggggcggcuggaagcuggagggggaguggaaggagggcgaggagguccaggugcucgcgcuggagcccgggaagaacccccgggccgugcagaccaagcccggccuguucaagaccaacaccgggacgaucggcgccgucucccucgacuucagccccggcaccuccgggagccccaucaucgacaagaagggcaaggugguggggcuguacggcaacggcgucgugacccgcuccggggccuacgugagcgccaucgcgcagaccgagaaguccaucgaggacaaccccgagaucgaggacgacaucuuccggaagcgccggcugacgaucauggaccugcaccccggcgccgggaagaccaagcgcuaccuccccgccaucguccgggaggccaucaagcgcggccugcggacccugauccucgcgccgacccgcgugguggccgccgagauggaggaggcccugcgggggcugcccauccgcuaccagacgcccgccauccgggcggagcacaccggccgcgagaucgucgaccucaugugccacgccaccuucaccaugcgccugcugagccccgugcgggugccgaacuacaaccucaucaucauggacgaggcccacuucacggaccccgccuccaucgccgcgcgcggcuacaucagcacccgggucgagaugggggaggccgccggcaucuucaugaccgccacgccgcccgggagccgcgacccguucccccaguccaacgcccccaucaucgacgaggagcgggagauccccgagcgcagcuggaacuccggccacgagugggugacggacuucaaggggaagaccgugugguucgucccgagcaucaaggcgggcaacgacaucgccgccugccugcggaagaacggcaagaaggugauccagcugucccgcaagaccuucgacagcgaguacgugaagacccggacgaacgacugggacuucgucgugaccaccgacaucuccgagaugggggccaacuucaaggcggagcgcgugaucgacccccggcgcugcaugaagcccgucauccucaccgacggcgaggagcgggugauccuggccgggcccaugccggugacgcacagcuccgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgcgagaaggucgacgccaucgacggggaguaccggcugcgcggcgaggcccgcaagaccuucguggaccucaugcggcgcggggaccugcccguguggcuggccuacaaggucgccgcggagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacuccgacccccucgcccugaaggaguucaaggaguucgccgcgggccgcaagagccugacgcucaaccugaucaccgagauggggcggcugcccaccuucaugacccagaagacgcgcgacgcccucgacaaccuggccguccugcacaccgccgaggcgggcgggcgggccuacaaccacgcccucuccgagcugcccgagacccuggagacccuccugcugcucacgcugcuggccaccgugaccggcggcaucuuccucuuccugaugagcgggcgcggcaucgggaagaugacccugggcaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucaccuacguggugaucgccauccugaccgucguggccgcgaccauggccaacgagaugggguuccuggagaagacgaagaaggaccucggccugggcuccaucgccacccagcagccggagagcaacauccuggacaucgaccuccgccccgccuccgccuggacccuguacgcgguggccaccacguucgucacccccaugcugcggcacagcaucgagaacagcuccgugaacgugagccucaccgccaucgccaaccaggccaccguccugauggggcugggcaagggguggccccucuccaagauggacaucggcgugccgcugcuggcgaucgggugcuacagccaggugaaccccaucacgcucaccgccgcccugcugcuccuggucgcccacuacgcgaucaucggccccggccugcaggccaaggccacccgcgaggcccagaagcgggccgcggccgggaucaugaagaaccccaccguggacggcaucacggugaucgaccucgacccgauccccuacgaccccaaguucgagaagcagcuggggcaggucaugcugcucauccugugcgugacccaggugcugaugaugcgcaccaccugggcccucugcgaggcccugacgcuggccaccggccccaucuccacccucugggaggggaacccgggccgguucuggaacaccacgaucgcggucagcauggccaacaucuuccgcggcuccuaccuggccggggccggccuccucuucagcaucaugaagaacaccaccaacacccggcgcgggacgggcaacaucggcgagacccugggggagaaguggaagucccgccugaacgcccucggcaagagcgaguuccagaucuacaagaaguccgggauccaggagguggaccggacccuggcgaaggagggcaucaagcgcggggagaccgaccaccacgccgugagccggggcuccgccaagcugcgcugguucgucgagcggaacauggugacgcccgagggcaagguggucgaccucgggugcggccgcgggggcuggagcuacuacugcgggggccugaagaacgugcgggaggugaagggccugaccaagggcggccccgggcacgaggagcccaucccgauguccaccuacggcuggaaccucguccgccugcagagcgggguggacguguucuucaucccgcccgagaagugcgacacccugcucugcgacaucggcgaguccagccccaacccgacggucgaggccggccggacccugcgcgugcugaaccucguggagaacuggcugaacaacaacacccaguucugcaucaagguccugaaccccuacaugcccuccgugaucgagaagauggaggcgcugcagcggaaguacgggggcgcccucgugcgcaacccgcugagccggaacagcacccacgagauguacugggucuccaacgccagcgggaacaucguguccagcgugaacaugaucucccgcaugcugaucaaccgguucaccaugcgccacaagaaggccacguacgagcccgacgucgaccucggcagcgggacccggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgcguccagcauggugaacggggugguccggcugcucaccaagccgugggacgugcugcccaccgugacgcagauggccaugaccgacaccacccccuucggccagcagcgcgucuucaaggagaagguggacacgcgcacccaggagcccaaggagggcaccaagaagcugaugaagaucaccgccgaguggcucuggaaggagcuggggaagaagaagacgccgcggaugugcacccgcgaggaguucacccggaaggugcgcuccaacgccgcccugggcgcgaucuucaccgacgagaacaaguggaaguccgcccgggaggccgucgaggacucccgcuucugggagcucguggacaaggagcggaaccugcaccuggaggggaagugcgagacgugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgccgacgacaccgcgggcugggacacccggaucacccucgaggaccugaagaacgaggagauggucacgaaccacauggagggggagcacaagaagcuggccgaggccaucuucaagcucaccuaccagaacaagguggugcgcguccagcggcccacgccccggggcaccgugauggacaucaucagccggcgcgaccagcggggguccggccaggugggcacguacgggcugaacaccuucaccaacauggaggcccagcugauccgccagauggagggcgagggggucuucaagaacauccagcaccucaccgccacggaggagaucgcggugcagaacuggcuggcccgggugggccgcgagcgccugagccggauggccaucuccggcgacgacugcgucgugaagccccucgacgaccgcuucgccaacgcccugaccgcgcugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccuccgcgagaccgccugccugggcaagagcuacgcccagauguggucccugauguacuuccaccggcgcgaccuccggcuggcggccaacgccaucugcagcgccguccccucccacugggugccgacgagccgcaccaccugguccauccacgccaagcacgaguggaugaccaccgaggacaugcugacgguguggaaccgggucuggauccgcgagaaccccuggauggaggacaagacccccguggagagcugggaggagauccccuaccucgggaagcgggaggaccaguggugcggcucccugaucgggcugaccagccgcgcgaccugggccaagaacauccaggccgccaucaaccaggugcggucccucaucggcaacgaggaguacacggacuacaugccgagcaugaagcgcuuccggcgcgaggaggaggaggcggggguccugugguga

SEQ ID NO: 9336 - RNA, 9876 nt, Artificial Sequence
  derived and/or modified CDS sequence (opt1) from DENV-2__FJ687445__SS-prME
agcgugggcaugaucaucaugcugauccccaccgugauggcguuccaccucaccacccgcaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacuccaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggccaagcugacgaacaccaccaccgagucccgcugccccacgcagggggagcccagccugaaggaggagcaggacaagcgguucgugugcaagcacuccaugguggaccgcggcuggggcaacgggugcggccucuucgggaagggcgggaucgugaccugcgccauguucacgugcaagaagaacauggagggcaagaucgugcagcccgagaaccuggaguacaccaucguggucacgccccacagcggcgaggagcacgccguggggaacgacaccggcaagcacgggaaggagaucaaggugaccccgcaguccagcaucaccgaggcggagcugaccggcuacgggacggucaccauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacgcuggucaccuucaagaacccccacgccaagaagcaggacguggucgugcucggcagccaggagggggccaugcacaccgcgcugaccggcgccacggagauccagauguccagcgggaaccuccuguucaccggccaccugaagugccggcugcgcauggacaagcuccagcugaagggcauguccuacagcaugugcaccgggaaguucaagguggucaaggagaucgccgagacccagcacggcacgaucgugauccgggugcaguacgagggggacggcucccccugcaagauccccuucgagaucauggaccuggagaagcgcuacguccucggccggcugaucaccgugaacccgaucgugaccgagaaggacagccccgucaacaucgaggccgagccgcccuucggggacuccuacaucaucaucggcguggagccggggcagcugaagcucaacugguucaagaagggcagcuccaucgggcagauguucgagaccacgaugcgcggcgccaagcgcauggcgauccugggcgacaccgccugggacuucgggagccugggcgggguguucaccuccaucggcaaggcccuccaccaggucuucggggccaucuacggcgccgcguucagcggcguguccuggaccaugaagauccugaucggggugaucaucacguggaucggcaugaacagccgguccaccagccuguccgucagccuggugcucgugggggucgugacccuguaccugggcgugaugguccaggccgacuccgggugcguggugagcuggaagaacaaggagcucaagugcggcagcggcaucuucaucaccgacaacguccacacguggaccgagcaguacaaguuccagcccgagucccccagcaagcuggccuccgccauccagaaggcgcaggaggaggggaucugcggcauccgcagcgugacccggcuggagaaccucauguggaagcagaucacccccgagcugaaccacauccuggccgagaacgaggugaagcucacgaucaugaccggggacaucaagggcaucaugcaggccgggaagcgcucccugcggccgcagcccaccgagcugaaguacagcuggaagaccuggggcaaggccaagaugcucuccacggagagccacaaccagaccuuccugaucgacggccccgagaccgccgagugcccgaacaccaaccgcgcguggaacucccuggaggucgaggacuacggguucggcguguucacgaccaacaucuggcucaagcugaaggagaagcaggacgccuucugcgacagcaagcugauguccgccgccaucaaggacaaccgggccgugcacgcggacaugggguacuggaucgagagcgcccucaacgacaccuggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgccggccccuggcaccuggggaagcuggagauggacuucgacuucugcgacggcacgaccgucguggugaccgaggacugcgggaaccggggccccagccuccgcaccacgaccgcgagcggcaagcugaucaccgaguggugcugccgguccugcacccugcccccgcuccgcuaccgcggggaggacggcugcugguacgggauggagauccgcccccugaaggagaaggaggagaaccuggucaacagccucgugacggccggccacgggcaggucgacaacuucucccugggcguccugggcauggcccucuuccuggaggagaugcugcggacccgcguggggaccaagcacgccauccuccugguggcggucagcuucgugacccugaucacgggcaacauguccuucaaggaccucgggcggguggucgugauggugggcgccaccaugaccgacgacaucgggaugggcgucaccuaccuggcccugcucgccgccuucaaggugcgccccacguucgcggccggccuguuccugcggaagcucaccagcaaggagcugaugaugaccaccaucgggaucgugcugcucucccagagcacgauccccgagaccauccuggagcugaccgacgcccucgcccugggcaugaugguccugaagauggugcgcgacauggagaaguaccagcucgccgucaccaucauggcgauccugugcgugccgaacgccgugauccugcagaacgccuggaaggucuccugcacgauccucgccguggugagcgucagcccccugcugcucaccagcucccagcagaagaccgacuggaucccccuggcccugaccaucaaggggcucaaccccacggcgaucuuccugaccacccugagccgcaccaacaagaagcgguccuggccgcucaacgaggccaucauggccgugggcauggugagcauccuggccuccagccugcucaagaacgacauccccaugacgggcccccuggucgccggcgggcugcucaccgugugcuacgugcugaccgggcgcuccgccgaccuggagcucgagcgggccaccgacgucaagugggaggaccaggccgagaucagcgggagcucccccauccugagcaucacgaucuccgaggacgggagcauguccaucaagaacgaggaggaggagcagacccugaccauccucauccgcaccggccugcuggugaucagcggccucuucccgguguccauccccaucaccgccgcggccugguaccugugggaggucaagaagcagcgggccggggugcugugggacgugcccuccccgccgcccaugggcaaggccgagcucgaggacggggccuaccgcaucaagcagcggggcauccugggguacucccagaucggcgcgggcgucuacaaggaggggacguuccacaccauguggcacgugacccgcggcgccgugcugacccacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucaucgacaagaaggggaagguggucggccucuacgggaacggcguggugacccggagcggcgccuacgucuccgccaucgcccagaccgagaaguccaucgaggacaaccccgacaucgaggacgacaucuuccgcaagcggcgccugaccaucauggaccugcaccccggggccggcaagacgaagcgguaccugcccgcgaucgugcgcgaggccaucaagcgggggcuccgcacccugauccuggccccgacccggguggucgccgcggagauggaggaggcccuccgcggccugcccauccgguaccagacccccgccauccgcgccgagcacacggggcgcgagaucguggaccugaugugccacgccaccuucaccaugcggcuccugucccccgugcgcgucccgaacuacaaccugaucaucauggacgaggcgcacuucaccgaccccgccagcaucgccgcccggggcuacaucagcacgcgcguggagaugggcgaggccgcggggaucuucaugaccgccacgccgcccggcucccgggacccguucccccagagcaacgcccccaucaucgacgaggagcgcgagauccccgagcgguccuggaacagcgggcacgagugggugaccgacuucaagggcaagacggucugguucgugccguccaucaaggccgggaacgacaucgccgcgugccuccgcaagaacggcaagaaggugauccagcugagccggaagaccuucgacuccgaguacgucaagacccgcaccaacgacugggacuucguggugacgaccgacaucagcgagaugggcgccaacuucaaggccgagcgggucaucgacccccgccggugcaugaagcccgugauccugaccgacggggaggagcgcgugauccucgccggccccaugccggucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgccaucgacggcgaguaccgccugcgcggggaggcgcggaagaccuucguggaccugaugcgccggggcgaccuccccgucuggcuggccuacaagguggccgccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucacggagaugggccgccugcccaccuucaugacccagaagacccgggacgcccuggacaaccucgcggugcugcacacggccgaggccgggggccgcgccuacaaccacgcgcugagcgagcuccccgagacccuggagacccugcuccugcugacccuccuggccaccgucaccgggggcaucuuccuguuccucauguccggccgggggaucggcaagaugacccuggggaugugcugcaucgugaccgccagcauccugcucugguacgcccagauccagccgcacuggaucgccgcguccaucauccuggaguucuuccugaucgugcuccugauccccgagcccgagaagcagcgcacgccccaggacaaccagcugacguacgucgugaucgccauccucaccguggucgccgccaccauggccaacgagaugggcuuccuggagaagaccaagaaggaccuggggcucggcagcaucgcgacgcagcagccggaguccaacauccuggacaucgaccugcggcccgccagcgccuggacccucuacgccguggccaccaccuucgugacgcccaugcugcgccacagcaucgagaacuccagcgucaacgugucccugaccgcgaucgccaaccaggccaccgugcucaugggccuggggaagggcuggccccugagcaagauggacaucggggccccgcuccuggccaucggcugcuacucccaggucaaccccaucacccugacggcggcccuccugcugcucguggcccacuacgccaucaucgggcccggccugcaggcgaaggccacccgggaggcccagaagcgcgccgccgcgggcaucaugaagaaccccaccguggacgggaucaccgucaucgaccuggacccgaucccccacgaccccaaguucgagaagcagcucggccaggugaugcugcuggugcucugcgucacccaggugcugaugaugcggaccaccugggcccugugcgaggcccucacccuggccacggggcccaucagcacccugugggagggcaacccggggcgcuucuggaacaccaccaucgccguguccauggcgaacaucuuccggggcagcuaccucgccggcgccgggcugcuguucuccaucaugaagaacacgaccaacagccgccgcggcaccgggaacaucggcgagacccucggcgagaaguggaagucccggcugaacgcccugggcaagagcgaguuccagaucuacaagaaguccggcauccaggaggucgaccgcacgcucgccaaggaggggaucaagcggggcgagaccgaccaccacgcggugagccgcggguccgccaagcugcggugguucguggagcgcaacauggucacccccgagggcaaggugguggaccugggcugcgggcggggcggguggagcuacuacugcggcgggcucaagaacguccgcgaggugaagggccugaccaagggcgggcccggccacgaggagcccaucccgauguccacguacggguggaaccuggugcggcuccagagcggcgucgacguguucuucaucccgcccgagaagugcgacacccugcugugcgacaucggggaguccagccccaacccgaccguggaggccggccgcacccuccggguccugaaccugguggagaacuggcucaacaacaacacccaguucugcaucaaggugcugaaccccuacaugcccagcgucaucgagaagauggagacgcugcagcgcaaguacggcggggcccuggugcggaacccgcucucccgcaacagcacccacgagauguacuggguguccaacgcgagcggcaacaucgucuccagcgugaacaugaucucccggaugcugaucaaccgcuucaccaugcggcacaagaaggccaccuacgagcccgacguggaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcugaccaagccgugggacguccuccccaccgugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagaccccgcgcaugugcacgcgggaggaguucacccgcaaggugcgguccaacgccgcccugggggccaucuucaccgacgagaacaaguggaaguccgcccgcgaggcggucgaggacucccgguucugggagcugguggacaaggagcgcaaccuccaccuggagggcaagugcgagaccugcguguacaacaugauggggaagcgggagaagaagcugggcgaguucgggaaggccaagggcagccgcgccaucugguacauguggcucggcgcccgguuccuggaguucgaggcccugggguuccucaacgaggaccacugguucucccgcgagaacagccugagcggcgucgagggggagggccugcaccggcucggguacauccugcgcgacguguccaagaaggagggcggcgcgauguacgccgacgacacggccgggugggacacccggaucacccuggaggaccucaagaacgaggagauggugaccaaccacauggagggcgagcacaagaagcuggccgaggcgaucuucaagcugacguaccagaacaaggucgugcgcgugcagcggcccacgccccgggggaccgucauggacaucaucagccggcgcgaccagcggggcuccggccagguggggaccuacggccucaacacguucaccaacauggaggcccagcugauccgccagauggagggggagggcguguucaagaacauccagcaccugaccgucaccgaggagaucgccgugcagaacuggcucgcccgcguggggcgggagcgccugagccggauggccaucuccggcgacgacugcgucgugaagccccuggacgaccgcuucgcgagcgcccucacggcccugaacgacaugggcaagauccggaaggacauccagcagugggagccgucccgcggguggaacgacuggacccaggugcccuucugcagccaccacuuccacgagcugaucaugaaggacggccggguccucguggugcccugccgcaaccaggacgagcugaucgggcgggcccgcaucucccagggcgccggguggagccugcgggagaccgcgugccucggcaaguccuacgcccagauguggagccugauguacuuccaccgccgggaccugcgccucgccgccaacgccaucugcuccgcgguccccagccacugggugccgaccucccggaccacguggagcauccacgccaagcacgaguggaugaccaccgaggacaugcugaccguguggaaccgcgucuggauccaggagaaccccuggauggaggacaagacgcccguggaguccugggaggagauccccuaccugggcaagcgggaggaccaguggugcgggagccucaucggccugaccagccgcgccaccugggccaagaacauccagguggccaucaaccagguccggucccugaucgggaacgaggaguacaccgacuacaugccgagcaugaagcgcuuccgccgggaggaggaggaggcgggcgugcucugguga

SEQ ID NO: 9337 - RNA, 9876 nt, Artificial Sequence
  derived and/or modified CDS sequence (opt1) from DENV-2__FJ687447__SS-prME
agcgccggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccucccucgacuucaacgagaugguccugcugcagauggagaacaaggccuggcucgugcaccgccagugguuccuggaccugccccuccccuggcugccgggcgccgacaagcaggagagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccgggcaccugaagugccggcugcgcauggacaagcuccagcugaagggcauguccuacagcaugugcacgggcaaguucaagguggugaaggagaucgccgagacccagcacgggaccaucgucauccgggugcaguacgagggcgacgggucccccugcaagauccccuucgagaucauggaccuggagaagcgcuacgugcucggccggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggggccaagcgcauggccauccugggcgacaccgccugggacuucggcagccucggcgggguguucacguccaucgggaaggcccuccaccagguguucggggcgaucuacggggccgccuucagcggcgucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcgggagcggcaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccugggggaaggcgaagaugcucuccaccgagagcuacaaccagaccuuccugaucgacggccccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggggugcuggagagcgagaugaucauccccaagaaccucgcgggccccgucucccagcacaacuaccgcccgggcuaccacacccagaucgccgggcccuggcaccugggcaagcuggagauggacuucgacuucugcgacgggaccaccgugaucgugacggaggacugcggcaaccgggggcccagccuccgcaccaccaccgccagcggcaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccuggggguccugggcauggcccuguuccuggaggagaugcugcggacccgcgugggcacgaagcacgccauccuccugguggccgucagcuucgugacccugaucaccgggaacauguccuucaaggaccucggccggguggucgugauggugggggccaccauggccgacgacaucggcaugggggucacguaccuggcgcugcucgccgccuucaaggugcgccccaccuucgccgccggccugcugcuccggaagcugaccagcaaggagcugaugaugaccacgaucggcaucgugcuccugucccagagcaccauccccgagaccauccuggagcucaccgacgcgcuggcccuggggaugaugguccucaagaucgugcgcaacauggagaaguaccagcuggccgugacgaucauggccauccugugcgucccgaacgccgugauccuccagaacgcguggaaggucuccugcaccauccuggccguggugagcgucagcccccugcuccugaccagcucccagcagaagaccgacuggaucccccuggcccucacgaucaagggccugaaccccaccgccaucuuccugaccacccucagccgcacgaacaagaagcgguccuggccgcugaacgaggcgaucauggccguggggauggugagcauccuggccuccagccuccugaagaacgacauccccaugaccggcccccuggucgccggcgggcuccugaccgugugcuacgugcugaccggccgcuccgccgaccucgagcuggagcgggcgacggacgucaagugggaggaccaggccgagaucagcgggagcucccccauccugagcaucaccaucuccgaggacggcagcauguccaucaagaacgaggaggaggagcagacccucaccauccugauccgcacggggcugcucgugaucagcggccuguucccgaucuccauccccaucaccgccgccgccugguaccugugggaggugaagaagcagcgggcgggcguccucugggacgugcccuccccgccgcccaucgggaaggccgagcuggaggacggcgccuaccgcaucaagcagaaggggauccugggcuacucccagaucggggccggcguguacaaggagggcaccuuccacaccauguggcacgucacccgcggggcggugcucaugcacaagggcaagcgcaucgagcccagcugggcggacgugaagaaggaccugaucuccuacgggggcggguggaagcuggagggcgaguggaaggagggcgaggagguccaggugcucgcccuggagcccgggaagaacccccgggccgugcagacgaagcccggccuguucaagaccaacaccgggaccaucggcgccgucagccucgacuucucccccgggacgagcggcucccccaucaucgacaagaagggcaaggugguggggcuguacggcaacggggucgugacccgcagcggcgccuacguguccgcgaucgcccagaccgagaaguccaucgaggacaaccccgagaucgaggacgacaucuuccggaagcgccggcugaccaucauggaccugcaccccggcgccgggaagacgaagcgcuaccuccccgccaucguccgggaggcgaucaagcgcggccugcggacccugauccucgccccgacccgcgugguggccgccgagauggaggaggcccugcgggggcugcccauccgcuaccagacccccgcgauccgggccgagcacacgggccgcgagaucgucgaccucaugugccacgccaccuucaccaugcgccugcugucccccgugcgggugccgaacuacaaccucaucaucauggacgaggcccacuucaccgaccccgccagcaucgcggcccgcggguacaucagcacgcgggucgagaugggcgaggccgccggcaucuucaugaccgccacgccgcccgggucccgcgacccguucccccagagcaacgcgcccaucaucgacgaggagcgggagauccccgagcgcuccuggaacagcggccacgagugggugaccgacuucaaggggaagacggugugguucgucccguccaucaaggccggcaacgacaucgccgccugccugcggaagaacgggaagaaggugauccagcugagccgcaagaccuucgacuccgaguacgugaagacccggaccaacgacugggacuucgucgugacgaccgacaucagcgagaugggcgcgaacuucaaggccgagcgcgugaucgacccccggcgcugcaugaagcccgucauccucaccgacggcgaggagcgggugauccuggccgggcccaugccggugacccacuccagcgccgcccagcgccggggccgcaucgggcggaaccccaagaacgagaacgaccaguacaucuacaugggcgagccccuggagaacgacgaggacugcgcgcacuggaaggaggccaagaugcuccuggacaacaucaacacgcccgaggggaucaucccguccauguucgagcccgagcgcgagaaggucgacgccaucgacggcgaguaccggcugcgcggcgaggcccgcaagaccuucguggaccucaugcggcgcggggaccugcccguguggcuggccuucaaggucgcggccgagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacagcgacccccucgcccugaaggaguucaaggaguucgcggccgggcgcaagucccugacccucaaccugaucacggagaugggccggcugcccaccuucaugacccagaagacccgcgacgcccucgacaaccuggccguccugcacacggcggaggccggcgggcgggccuacaaccacgcccucagcgagcugcccgagacccuggagacccuccugcugcucacccugcuggccacggugaccggcgggaucuuccucuuccugauguccggccgcggcaucgggaagaugacccugggcaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucacguacguggugaucgccauccugaccgucguggcggccaccauggccaacgagaugggguuccuggagaagaccaagaaggaccucggccuggggagcaucgccacgcagcagccggaguccaacauccuggacaucgaccuccgccccgccagcgcguggacccuguacgccguggccaccaccuucgucacgcccaugcugcggcacagcaucgagaacuccagcgugaacgugucccucaccgccaucgccaaccaggcgaccguccugaugggccugggcaagggguggccccucagcaagauggacaucggcgugccgcugcuggccaucgggugcuacucccaggugaaccccaucacccucacggccgcccugcugcuccuggucgcgcacuacgccaucaucggccccgggcugcaggccaaggccacccgcgaggcccagaagcgggcggccgccggcaucaugaagaaccccaccguggacggcaucaccgugaucgaccucgacccgauccccuacgaccccaaguucgagaagcagcuggggcaggucaugcugcucauccugugcgugacccaggugcugaugaugcgcaccaccugggcccucugcgaggcccugacccuggcgacgggccccaucagcacccucugggaggggaacccgggccgguucuggaacaccaccaucgccgucuccauggccaacaucuuccgcgggagcuaccuggccggcgccggccuccucuucuccaucaugaagaacacgaccaacacccggcgcgggaccggcaacaucggggagacgcugggcgagaaguggaagucccgccugaacgcgcucggcaaguccgaguuccagaucuacaagaaguccgggauccaggagguggaccggacccuggccaaggagggcaucaagcgcggggagaccgaccaccacgccgugucccggggcagcgccaagcugcgcugguucgucgagcggaacauggugacccccgaggggaagguggucgaccucggcugcggccgcgggggcugguccuacuacugcgggggccugaagaacgugcgggaggugaaggggcugacgaagggcggccccgggcacgaggagcccaucccgaugagcaccuacggcuggaaccucguccgccugcaguccgggguggacguguucuucaucccgcccgagaagugcgacacccugcucugcgacaucggcgagagcucccccaacccgaccgucgaggcggggcggacgcugcgcgugcugaaccucguggagaacuggcugaacaacaacacccaguucugcaucaagguccugaaccccuacaugcccagcgugaucgagaagauggaggcccugcagcggaaguacggcggcgcccucgugcgcaacccgcugagccggaacuccacccacgagauguacugggucagcaacgccuccgggaacaucgugagcuccgugaacaugaucagccgcaugcugaucaaccgguucaccaugcgccacaagaaggccaccuacgagcccgacgucgaccucggcuccgggacgcggaacaucggcaucgagagcgagauccccaaccuggacaucaucgggaagcgcaucgagaagaucaagcaggagcacgagaccuccuggcacuacgaccaggaccaccccuacaagaccugggcguaccacggcagcuacgagaccaagcagacgggcuccgccagcuccauggugaacggggugguccggcugcucaccaagccgugggacgugcugcccaccgugacccagauggccaugacggacaccacccccuucggccagcagcgcgucuucaaggagaagguggacacccgcacgcaggagcccaaggaggggaccaagaagcugaugaagaucaccgccgaguggcucuggaaggagcugggcaagaagaagaccccgcggaugugcacgcgcgaggaguucacccggaaggugcgcagcaacgccgcgcugggcgccaucuucaccgacgagaacaaguggaaguccgcccgggaggccgucgaggacagccgcuucugggagcucguggacaaggagcggaaccugcaccuggaggggaagugcgagaccugcguguacaacaugaugggcaagcgcgagaagaagcucggggaguucggcaaggccaaggggucccgggcgaucugguacauguggcugggcgcccgcuuccuggaguucgaggcccucggcuuccugaacgaggaccacugguucagccgggagaacucccugagcggggucgagggcgaggggcuccacaagcugggcuacauccugcgcgacgugagcaagaaggagggcggcgccauguacgcggacgacacggccggcugggacacccggaucacccucgaggaccugaagaacgaggagauggucaccaaccacauggagggggagcacaagaagcuggccgaggccaucuucaagcucacguaccagaacaagguggugcgcguccagcggcccacgccccggggcaccgugauggacaucaucucccggcgcgaccagcgggggagcggccagguggggaccuacggccugaacacguucaccaacauggaggcccagcugauccgccagauggagggcgagggggucuucaagaacauccagcaccucaccgugaccgaggagguggcgguccagaacuggcuggcccgggugggccgcgagcgccugucccggauggccaucagcggggacgacugcguggucaagccccucgacgaccgcuucgccaacgcccugacggcgcugaacgacaugggcaagauccggaaggacauccagcagugggagccguccaagggcuggaacgacuggacccaggugcccuucugcagccaccacuuccacgagcucaucaugaaggacgggcgcgugcuggucgugcccugccggaaccaggacgagcugaucggccgcgcccggaucucccagggggccggcuggagccuccgcgagaccgccugccuggggaaguccuacgcccagauguggagccugauguacuuccaccggcgcgaccuccggcuggcggccaacgccaucugcuccgccgugcccagccacugggucccgaccucccgcacgaccuggagcauccacgccaagcacgaguggaugaccaccgaggacaugcugaccguguggaaccggguguggauccgcgagaaccccuggauggaggacaagacgcccgucgaguccugggaggagauccccuaccucggcaagcgggaggaccaguggugcggcagccugaucgggcugaccucccgcgcgaccugggccaagaacauccaggccgccaucaaccaggugcggagccucaucggcaacgaggaguacaccgacuacaugccgagcaugaagcgcuuccggcgcgaggaggaggaggcgggggugcugugguga

SEQ ID NO: 9338 - RNA, 9876 nt, Artificial Sequence
  derived and/or modified CDS sequence (opt1) from DENV-2__FJ810411__SS-prME
agcgccggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccucccucgacuucaacgagaugguccugcugcagauggagaacaaggccuggcucgugcaccgccagugguuccuggaccugccccuccccuggcugccgggcgccgacaagcaggagagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccgggcaccugaagugccggcugcgcauggacaagcuccagcugaagggcauguccuacagcaugugcacgggcaaguucaagguggugaaggagaucgccgagacccagcacgggaccaucgucauccgggugcaguacgagggcgacgggucccccugcaagauccccuucgagaucauggaccuggagaagcgcuacgugcucggccggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggggccaagcgcauggccauccugggcgacaccgccugggacuucggcagccucggcgggguguucacguccaucgggaaggcccuccaccagguguucggggcgaucuacggggccgccuucagcggcgucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcgggagcggcaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccugggggaaggcgaagaugcucuccaccgagagcuacaaccagaccuuccugaucgacggccccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggggugcuggagagcgagaugaucauccccaagaaccucgcgggccccgucucccagcacaacuaccgcccgggcuaccacacccagaucgccgggcccuggcaccugggcaagcuggagauggacuucgacuucugcgacgggaccaccgugaucgugacggaggacugcggcaaccgggggcccagccuccgcaccaccaccgccagcggcaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccuggggguccugggcauggcccuguuccuggaggagaugcugcggacccgcgugggcacgaagcacgccauccuccugguggccgucagcuucgugacccugaucaccgggaacauguccuucaaggaccucggccggguggucgugauggugggggccaccauggccgacgacaucggcaugggggucacguaccuggcgcugcucgccgccuucaaggugcgccccaccuucgccgccggccugcugcuccggaagcugaccagcaaggagcugaugaugaccacgaucggcaucgugcuccugucccagagcaccauccccgagaccauccuggagcucaccgacgcgcuggcccuggggaugaugguccucaagaucgugcgcaacauggagaaguaccagcuggccgugacgaucauggccauccugugcgucccgaacgccgugauccuccagaacgcguggaaggucuccugcaccauccuggccguggugagcgucagcccccugcuccugaccagcucccagcagaagaccgacuggaucccccuggcccucacgaucaagggccugaaccccaccgccaucuuccugaccacccucagccgcacgaacaagaagcgguccuggccgcugaacgaggcgaucauggccguggggauggugagcauccuggccuccagccuccugaagaacgacauccccaugaccggcccccuggucgccggcgggcuccugaccgugugcuacgugcugaccggccgcuccgccgaccucgagcuggagcgggcgacggacgucaagugggaggaccaggccgagaucagcgggagcucccccauccugagcaucaccaucuccgaggacggcagcauguccaucaagaacgaggaggaggagcagacccucaccauccugauccgcacggggcugcucgugaucagcggccuguucccgaucuccauccccaucaccgccgccgccugguaccugugggaggugaagaagcagcgggcgggcguccucugggacgugcccuccccgccgcccaucgggaaggccgagcuggaggacggcgccuaccgcaucaagcagaaggggauccugggcuacucccagaucggggccggcguguacaaggagggcaccuuccacaccauguggcacgucacccgcggggcggugcucaugcacaagggcaagcgcaucgagcccagcugggcggacgugaagaaggaccugaucuccuacgggggcggguggaagcuggagggcgaguggaaggagggcgaggagguccaggugcucgcccuggagcccgggaagaacccccgggccgugcagacgaagcccggccuguucaagaccaacaccgggaccaucggcgccgucagccucgacuucucccccgggacgagcggcucccccaucaucgacaagaagggcaaggugguggggcuguacggcaacggggucgugacccgcagcggcgccuacguguccgcgaucgcccagaccgagaaguccaucgaggacaaccccgagaucgaggacgacaucuuccggaagcgccggcugaccaucauggaccugcaccccggcgccgggaagacgaagcgcuaccuccccgccaucguccgggaggcgaucaagcgcggccugcggacccugauccucgccccgacccgcgugguggccgccgagauggaggaggcccugcgggggcugcccauccgcuaccagacccccgcgauccgggccgagcacacgggccgcgagaucgucgaccucaugugccacgccaccuucaccaugcgccugcugucccccgugcgggugccgaacuacaaccucaucaucauggacgaggcccacuucaccgaccccgccagcaucgcggcccgcggguacaucagcacgcgggucgagaugggcgaggccgccggcaucuucaugaccgccacgccgcccgggucccgcgacccguucccccagagcaacgcgcccaucaucgacgaggagcgggagauccccgagcgcuccuggaacagcggccacgagugggugaccgacuucaaggggaagacggugugguucgucccguccaucaaggccggcaacgacaucgccgccugccugcggaagaacgggaagaaggugauccagcugagccgcaagaccuucgacuccgaguacgugaagacccggaccaacgacugggacuucgucgugacgaccgacaucagcgagaugggcgcgaacuucaaggccgagcgcgugaucgacccccggcgcugcaugaagcccgucauccucaccgacggcgaggagcgggugauccuggccgggcccaugccggugacccacuccagcgccgcccagcgccggggccgcaucgggcggaaccccaagaacgagaacgaccaguacaucuacaugggcgagccccuggagaacgacgaggacugcgcgcacuggaaggaggccaagaugcuccuggacaacaucaacacgcccgaggggaucaucccguccauguucgagcccgagcgcgagaaggucgacgccaucgacggcgaguaccggcugcgcggcgaggcccgcaagaccuucguggaccucaugcggcgcggggaccugcccguguggcuggccuucaaggucgcggccgagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacagcgacccccucgcccugaaggaguucaaggaguucgcggccgggcgcaagucccugacccucaaccugaucacggagaugggccggcugcccaccuucaugacccagaagacccgcgacgcccucgacaaccuggccguccugcacacggcggaggccggcgggcgggccuacaaccacgcccucagcgagcugcccgagacccuggagacccuccugcugcucacccugcuggccacggugaccggcgggaucuuccucuuccugauguccggccgcggcaucgggaagaugacccugggcaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucacguacguggugaucgccauccugaccgucguggcggccaccauggccaacgagaugggguuccuggagaagaccaagaaggaccucggccuggggagcaucgccacgcagcagccggaguccaacauccuggacaucgaccuccgccccgccagcgcguggacccuguacgccguggccaccaccuucgucacgcccaugcugcggcacagcaucgagaacuccagcgugaacgugucccucaccgccaucgccaaccaggcgaccguccugaugggccugggcaagggguggccccucagcaagauggacaucggcgugccgcugcuggccaucgggugcuacucccaggugaaccccaucacccucacggccgcccugcugcuccuggucgcgcacuacgccaucaucggccccgggcugcaggccaaggccacccgcgaggcccagaagcgggcggccgccggcaucaugaagaaccccaccguggacggcaucaccgugaucgaccucgacccgauccccuacgaccccaaguucgagaagcagcuggggcaggucaugcugcucauccugugcgugacccaggugcugaugaugcgcaccaccugggcccucugcgaggcccugacccuggcgacgggccccaucagcacccucugggaggggaacccgggccgguucuggaacaccaccaucgccgucuccauggccaacaucuuccgcgggagcuaccuggccggcgccggccuccucuucuccaucaugaagaacacgaccaacacccggcgcgggaccggcaacaucggggagacgcugggcgagaaguggaagucccgccugaacgcgcucggcaaguccgaguuccagaucuacaagaaguccgggauccaggagguggaccggacccuggccaaggagggcaucaagcgcggggagaccgaccaccacgccgugucccggggcagcgccaagcugcgcugguucgucgagcggaacauggugacccccgaggggaagguggucgaccucggcugcggccgcgggggcugguccuacuacugcgggggccugaagaacgugcgggaggugaaggggcugacgaagggcggccccgggcacgaggagcccaucccgaugagcaccuacggcuggaaccucguccgccugcaguccgggguggacguguucuucaucccgcccgagaagugcgacacccugcucugcgacaucggcgagagcucccccaacccgaccgucgaggcggggcggacgcugcgcgugcugaaccucguggagaacuggcugaacaacaacacccaguucugcaucaagguccugaaccccuacaugcccagcgugaucgagaagauggaggcccugcagcggaaguacggcggcgcccucgugcgcaacccgcugagccggaacuccacccacgagauguacugggucagcaacgccuccgggaacaucgugagcuccgugaacaugaucagccgcaugcugaucaaccgguucaccaugcgccacaagaaggccaccuacgagcccgacgucgaccucggcuccgggacgcggaacaucggcaucgagagcgagauccccaaccuggacaucaucgggaagcgcaucgagaagaucaagcaggagcacgagaccuccuggcacuacgaccaggaccaccccuacaagaccugggcguaccacggcagcuacgagaccaagcagacgggcuccgccagcuccauggugaacggggugguccggcugcucaccaagccgugggacgugcugcccaccgugacccagauggccaugacggacaccacccccuucggccagcagcgcgucuucaaggagaagguggacacccgcacgcaggagcccaaggaggggaccaagaagcugaugaagaucaccgccgaguggcucuggaaggagcugggcaagaagaagaccccgcggaugugcacgcgcgaggaguucaccaagaaggugcggagcaacgccgcgcugggcgccaucuucaccgacgagaacaaguggaaguccgcccgcgaggccgucgaggacagccgguucugggagcucguggacaaggagcgcaaccugcaccuggaggggaagugcgagaccugcguguacaacaugaugggcaagcgggagaagaagcucggggaguucggcaaggccaaggggucccgcgcgaucugguacauguggcugggcgcccgguuccuggaguucgaggcccucggcuuccugaacgaggaccacugguucagccgcgagaacucccugagcggggucgagggcgaggggcuccacaagcugggcuacauccugcgggacgugagcaagaaggagggcggcgccauguacgcggacgacacggccggcugggacacccgcaucacccucgaggaccugaagaacgaggagauggucaccaaccacauggagggggagcacaagaagcuggccgaggccaucuucaagcucacguaccagaacaagguggugcggguccagcgccccacgccccggggcaccgugauggacaucaucucccgccgggaccagcgcgggagcggccagguggggaccuacggccugaacacguucaccaacauggaggcccagcugauccggcagauggagggcgagggggucuucaagaacauccagcaccucaccgugaccgaggagguggcgguccagaacuggcuggcccgcgugggccgggagcgccugucccgcauggccaucagcggggacgacugcguggucaagccccucgacgaccgguucgccaacgcccugacggcgcugaacgacaugggcaagauccgcaaggacauccagcagugggagccguccaagggcuggaacgacuggacccaggugcccuucugcagccaccacuuccacgagcucaucaugaaggacgggcgggugcuggucgugcccugccgcaaccaggacgagcugaucggccgggcccgcaucucccagggggccggcuggagccuccgggagaccgccugccuggggaaguccuacgcccagauguggagccugauguacuuccaccgccgggaccuccgccuggcggccaacgccaucugcuccgccgugcccagccacugggucccgaccucccggacgaccuggagcauccacgccaagcacgaguggaugaccaccgaggacaugcugaccguguggaaccgcguguggauccgggagaaccccuggauggaggacaagacgcccgucgaguccugggaggagauccccuaccucggcaagcgcgaggaccaguggugcggcagccugaucgggcugaccucccgggcgaccugggccaagaacauccaggccgccaucaaccaggugcgcagccucaucggcaacgaggaguacaccgacuacaugccgagcaugaagcgguuccgccgggaggaggaggaggcgggggugcugugguga

SEQ ID NO: 9339 - RNA, 9876 nt, Artificial Sequence
  derived and/or modified CDS sequence (opt1) from DENV-2__FJ744713__SS-prME
agcgccggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacgcggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccucccucgacuucaacgagaugguccugcugcagauggagaacaaggccuggcucgugcaccgccagugguuccuggaccugccccuccccuggcugccgggcgccgacaagcaggagagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccgggcaccugaagugccggcugcgcauggacaagcuccagcugaagggcauguccuacagcaugugcacgggcaaguucaagguggugaaggagaucgccgagacccagcacgggaccaucgucauccgggugcaguacgagggcgacgggucccccugcaagauccccuucgagaucauggaccuggagaagcgcuacgugcucggccggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggggccaagcgcauggccauccugggcgacaccgccugggacuucggcagccucggcgggguguucacguccaucgggaaggcccuccaccagguguucggggcgaucuacggggccgccuucagcggcgucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcgggagcggcaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccugggggaaggcgaagaugcucuccaccgagagcuacaaccagaccuuccugaucgacggccccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggggugcuggagagcgagaugaucauccccaagaaccucgcgggccccgucucccagcacaacuaccgcccgggcuaccacacccagaucgccgggcccuggcaccugggcaagcuggagauggacuucgacuucugcgacgggaccaccgugaucgugacggaggacugcggcaaccgggggcccagccuccgcaccaccaccgccagcggcaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccuggggguccugggcauggcccuguuccuggaggagaugcugcggacccgcgugggcacgaagcacgccauccuccugguggccgucagcuucgugacccugaucaccgggaacauguccuucaaggaccucggccggguggucgugauggugggggccaccauggccgacgacaucggcaugggggucacguaccuggcgcugcucgccgccuucaaggugcgccccaccuucgccgccggccugcugcuccggaagcugaccagcaaggagcugaugaugaccacgaucggcaucgugcuccugucccagagcaccauccccgagaccauccuggagcucaccgacgcgcuggcccuggggaugaugguccucaagaucgugcgcaacauggagaaguaccagcuggccgugacgaucauggccauccugugcgucccgaacgccgugauccuccagaacgcguggaaggucuccugcaccauccuggccguggugagcgucagcccccugcuccugaccagcucccagcagaagaccgacuggaucccccuggcccucacgaucaagggccugaaccccaccgccaucuuccugaccacccucagccgcacgaacaagaagcgguccuggccgcugaacgaggcgaucauggccguggggauggugagcauccuggccuccagccuccugaagaacgacauccccaugaccggcccccuggucgccggcgggcuccugaccgugugcuacgugcugaccggccgcuccgccgaccucgagcuggagcgggcgacggacgucaagugggaggaccaggccgagaucagcgggagcucccccauccugagcaucaccaucuccgaggacggcagcauguccaucaagaacgaggaggaggagcagauccucaccauccugauccgcaccgggcugcucgugaucagcggccuguucccgaucuccauccccaucacggccgccgccugguaccugugggaggugaagaagcagcgggcgggcguccucugggacgugcccuccccgccgcccaucgggaaggccgagcuggaggacggcgccuaccgcaucaagcagaaggggauccugggcuacucccagaucggggccggcguguacaaggagggcaccuuccacaccauguggcacgucacccgcggggcggugcucaugcacaagggcaagcgcaucgagcccagcugggcggacgugaagaaggaccugaucuccuacgggggcggguggaagcuggagggcgaguggaaggagggcgaggagguccaggugcucgcccuggagcccgggaagaacccccgggccgugcagaccaagcccggccuguucaagacgaacaccgggaccaucggcgccgucagccucgacuucucccccgggaccagcggcucccccaucaucgacaagaagggcaaggugguggggcuguacggcaacggggucgugacgcgcagcggcgccuacguguccgcgaucgcccagaccgagaaguccaucgaggacaaccccgagaucgaggacgacaucuuccggaagcgccggcugaccaucauggaccugcaccccggcgccgggaagaccaagcgcuaccuccccgccaucguccgggaggcgaucaagcgcggccugcggacgcugauccucgccccgacccgcgugguggccgccgagauggaggaggcccugcgggggcugcccauccgcuaccagacccccgcgauccgggccgagcacaccggccgcgagaucgucgaccucaugugccacgccacguucaccaugcgccugcugucccccgugcgggugccgaacuacaaccucaucaucauggacgaggcccacuucaccgaccccgccagcaucgcggcccgcggguacaucagcacccgggucgagaugggcgaggccgccggcaucuucaugacggccacgccgcccgggucccgcgacccguucccccagagcaacgcgcccaucaucgacgaggagcgggagauccccgagcgcuccuggaacagcggccacgagugggugaccgacuucaaggggaagaccgugugguucgucccguccaucaaggccggcaacgacaucgccgccugccugcggaagaacgggaagaaggugauccagcugagccgcaagacguucgacuccgaguacgugaagacccggaccaacgacugggacuucgucgugaccacggacaucagcgagaugggcgcgaacuucaaggccgagcgcgugaucgacccccggcgcugcaugaagcccgucauccucaccgacggcgaggagcgggugauccuggccgggcccaugccggugacccacuccagcgccgcccagcgccggggccgcaucgggcggaaccccaagaacgagaacgaccaguacaucuacaugggcgagccccuggagaacgacgaggacugcgcgcacuggaaggaggccaagaugcuccuggacaacaucaacacccccgaggggaucaucccguccauguucgagcccgagcgcgagaaggucgacgccaucgacggcgaguaccggcugcgcggcgaggcccgcaagacguucguggaccucaugcggcgcggggaccugcccguguggcuggccuucaaggucgcggccgagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacagcgacccccucgcccugaaggaguucaaggaguucgcggccgggcgcaagucccugacccucaaccugaucaccgagaugggccggcugcccacguucaugacccagaagacccgcgacgcccucgacaaccuggccguccugcacaccgcggaggccggcgggcgggccuacaaccacgcccucagcgagcugcccgagacgcuggagacccuccugcugcucacccugcuggccaccgugacgggcgggaucuuccucuuccugauguccggccgcggcaucgggaagaugacccugggcaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucaccuacguggugaucgccauccugacggucguggcggccaccauggccaacgagaugggguuccuggagaagaccaagaaggaccucggccuggggagcaucgccacccagcagccggaguccaacauccuggacaucgaccuccgccccgccagcgcguggacgcuguacgccguggccaccaccuucgucacccccaugcugcggcacagcaucgagaacuccagcgugaacgugucccucacggccaucgccaaccaggcgaccguccugaugggccugggcaagggguggccccucagcaagauggacaucggcgugccgcugcuggccaucgggugcuacucccaggugaaccccaucacccucaccgccgcccugcugcuccuggucgcgcacuacgccaucaucggccccgggcugcaggccaaggccacgcgcgaggcccagaagcgggcggccgccggcaucaugaagaaccccaccguggacggcaucaccgugaucgaccucgacccgauccccuacgaccccaaguucgagaagcagcuggggcaggucaugcugcucauccugugcgugacccaggugcugaugaugcgcacgaccugggcccucugcgaggcccugacccuggcgaccggccccaucagcacgcucugggaggggaacccgggccgguucuggaacaccaccaucgccgucuccauggccaacaucuuccgcgggagcuaccuggccggcgccggccuccucuucuccaucaugaagaacaccacgaacacccggcgcgggaccggcaacaucggggagacccugggcgagaaguggaagucccgccugaacgcgcucggcaaguccgaguuccagaucuacaagaaguccgggauccaggagguggaccggacgcuggccaaggagggcaucaagcgcggggagaccgaccaccacgccgugucccggggcagcgccaagcugcgcugguucgucgagcggaacauggugacccccgaggggaagguggucgaccucggcugcggccgcgggggcugguccuacuacugcgggggccugaagaacgugcgggaggugaaggggcugaccaagggcggccccgggcacgaggagcccaucccgaugagcacguacggcuggaaccucguccgccugcaguccgggguggacguguucuucaucccgcccgagaagugcgacacccugcucugcgacaucggcgagagcucccccaacccgaccgucgaggcggggcggacccugcgcgugcugaaccucguggagaacuggcugaacaacaacacgcaguucugcaucaagguccugaaccccuacaugcccagcgugaucgagaagauggaggcccugcagcggaaguacggcggcgcccucgugcgcaacccgcugagccggaacuccacccacgagauguacugggucagcaacgccuccgggaacaucgugagcuccgugaacaugaucagccgcaugcugaucaaccgguucaccaugcgccacaagaaggccaccuacgagcccgacgucgaccucggcuccgggacccggaacaucggcaucgagagcgagauccccaaccuggacaucaucgggaagcgcaucgagaagaucaagcaggagcacgagacguccuggcacuacgaccaggaccaccccuacaagaccugggcguaccacggcagcuacgagaccaagcagaccggcuccgccagcuccauggugaacggggugguccggcugcucacgaagccgugggacgugcugcccaccgugacccagauggccaugaccgacacgacccccuucggccagcagcgcgucuucaaggagaagguggacacccgcacccaggagcccaaggaggggacgaagaagcugaugaagaucaccgccgaguggcucuggaaggagcugggcaagaagaagaccccgcggaugugcacccgcgaggaguucacgcggaaggugcgcagcaacgccgcgcugggcgccaucuucaccgacgagaacaaguggaaguccgcccgggaggccgucgaggacagccgcuucugggagcucguggacaaggagcggaaccugcaccuggaggggaagugcgagaccugcguguacaacaugaugggcaagcgcgagaagaagcucggggaguucggcaaggccaaggggucccgggcgaucugguacauguggcugggcgcccgcuuccuggaguucgaggcccucggcuuccugaacgaggaccacugguucagccgggagaacucccugagcggggucgagggcgaggggcuccacaagcugggcuacauccugcgcgacgugagcaagaaggagggcggcgccauguacgcggacgacaccgccggcugggacacgcggaucacccucgaggaccugaagaacgaggagauggucaccaaccacauggagggggagcacaagaagcuggccgaggccaucuucaagcucaccuaccagaacaagguggugcgcguccagcggcccacgccccgcggcaccgugauggacaucaucucccggcgcgaccagcgggggagcggccagguggggaccuacggccugaacaccuucacgaacauggaggcccagcugauccgccagauggagggcgagggggucuucaagaacauccagcaccucaccgugaccgaggagguggcgguccagaacuggcuggcccgggugggccgcgagcgccugucccggauggccaucagcggggacgacugcguggucaagccccucgacgaccgcuucgccaacgcccugaccgcgcugaacgacaugggcaagauccggaaggacauccagcagugggagccguccaagggcuggaacgacuggacccaggugcccuucugcagccaccacuuccacgagcucaucaugaaggacgggcgcgugcuggucgugcccugccggaaccaggacgagcugaucggccgcgcccggaucucccagggggccggcuggagccuccgcgagaccgccugccuggggaaguccuacgcccagauguggagccugauguacuuccaccggcgcgaccuccggcuggcggccaacgccaucugcuccgccgugcccagccacugggucccgaccucccgcaccacguggagcauccacgccaagcacgaguggaugaccaccgaggacaugcugaccguguggaaccggguguggauccgcgagaaccccuggauggaggacaagacccccgucgaguccugggaggagauccccuaccucggcaagcgggaggaccaguggugcggcagccugaucgggcugacgucccgcgcgaccugggccaagaacauccaggccgccaucaaccaggugcggagccucaucggcaacgaggaguacaccgacuacaugccgagcaugaagcgcuuccggcgcgaggaggaggaggcgggggugcugugguga

SEQ ID NO: 9340 - RNA, 9876 nt, Artificial Sequence
  derived and/or modified CDS sequence (opt1) from DENV-2__FJ744714__SS-prME
agcgccgggaugaucaucaugcugauccccaccgugauggccuuccaccucaccacccggaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcggagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcggguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagcggauccugggcuacagccagaucggggccggcguguacaaggagggcaccuuccacaccauguggcacgugacccgcggggccguccucaugcacaagggcaagcggaucgagcccuccugggccgacgugaagaaggaccugaucagcuacgggggcggguggaagcuggagggcgaguggaaggagggcgaggaggugcagguccucgcgcuggagcccgggaagaacccccgcgccgugcagacgaagcccggccuguucaagaccaacaccgggaccaucggcgccgugucccucgacuucagccccgggacguccggcagccccaucaucgacaagaagggcaaggucguggggcuguacggcaacgggguggucacccgguccggcgccuacgugagcgccaucgcgcagaccgagaaguccaucgaggacaaccccgagaucgaggacgacaucuuccgcaagcggcgccugaccaucauggaccugcaccccggcgccgggaagacgaagcgguaccuccccgccaucgugcgcgaggccaucaagcggggccugcgcacccugauccucgcgccgacccgggucguggccgccgagauggaggaggcccugcgcgggcugcccauccgguaccagacccccgccauccgcgcggagcacacgggccgcgagaucguggaccucaugugccacgccaccuucaccaugcggcugcugagccccguccgcgugccgaacuacaaccucaucaucauggacgaggcccacuucaccgaccccgccuccaucgccgcgcggggguacaucagcacgcgcguggagaugggcgaggccgccggcaucuucaugaccgccacgccgcccgggagccgggacccguucccccaguccaacgcccccaucaucgacgaggagcgcgagauccccgagcggagcuggaacuccggccacgagugggucaccgacuucaaggggaagacggugugguucgugccgagcaucaaggcgggcaacgacaucgccgccugccugcgcaagaacgggaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggcgaggagcgcgucauccuggccgggcccaugccggugacccacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgcccgaggggaucaucccgagcauguucgagcccgagcgggagaagguggacgccaucgacggcgaguaccgccugcgcggcgaggcccggaagaccuucgucgaccucaugcgccgcggggaccugcccguguggcuggccuacaagguggccgcggagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcggggcggaagucccugacccucaaccugaucacggagaugggccgccugcccaccuucaugacccagaagacccgggacgcccucgacaaccuggccguccugcacacggccgaggcgggcgggcgcgccuacaaccacgcccucuccgagcugcccgagacccuggagacccuccugcugcucacccugcuggccacggugaccggcgggaucuuccucuuccugaugagcggccggggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggguuccuggagaagaccaagaaggaccucggccugggguccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccugggcaagggguggccccucuccaagauggacaucggcgucccgcugcuggcgaucgggugcuacagccaggugaaccccaucacccucacggccgcccugcugcuccugguggcccacuacgcgaucaucggccccgggcugcaggccaaggccacccgggaggcccagaagcgcgccgcggccggcaucaugaagaaccccaccgucgacggcaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacgggccccaucuccacccucugggaggggaacccgggccgcuucuggaacaccaccaucgcggugagcauggccaacaucuuccggggguccuaccuggccggcgccggccuccucuucagcaucaugaagaacacgaccaacacccgccgcgggaccggcaacaucggggagacgcugggcgagaaguggaagucccggcugaacgcccucggcaagagcgaguuccagaucuacaagaaguccgggauccaggaggucgaccgcacccuggcgaaggagggcaucaagcgcggggagaccgaccaccacgccgugagccgcggcuccgccaagcugcggugguucguggagcgcaacauggucacccccgaggggaaggugguggaccucggcugcggccgcggcggguggagcuacuacugcgggggccugaagaacguccgcgaggugaaggggcugacgaagggcggccccgggcacgaggagcccaucccgauguccaccuacggcuggaaccucgugcggcugcagagcggggucgacguguucuucaucccgcccgagaagugcgacacccugcucugcgacaucggcgaguccagccccaacccgaccguggaggccgggcgcacgcugcggguccugaaccucguggagaacuggcugaacaacaacacccaguucugcaucaaggugcugaaccccuacaugcccuccgucaucgagaagauggaggcgcugcagcgcaaguacggcggcgcccucgugcggaacccgcugagccgcaacagcacccacgagauguacuggguguccaacgccagcgggaacaucgucuccagcgugaacaugaucucccggaugcugaucaaccgcuucaccaugcggcacaagaaggccaccuacgagcccgacguggaccucggcagcgggacgcgcaacaucggcaucgaguccgagguccccaaccuggacaucaucgggaagcggaucgagaagaucaagcaggagcacgagaccagcuggcacuacgaccaggaccaccccuacaagaccugggccuaccacggcuccuacgagaccaagcagacgggcagcgcguccagcauggugaacggggugguccgccugcucaccaagccgugggacgugcugcccaccgugacccagauggccaugacggacaccacccccuucggccagcagcgcgucuucaaggagaagguggacacccggacgcaggagcccaaggaggggaccaagaagcugaugaagaucaccgccgaguggcucuggaaggagcugggcaagaagaagaccccgcgcaugugcacgcgggaggaguucacccgcaaggugcgguccaacgccgcccugggcgcgaucuucaccgacgagaacaaguggaaguccgcccgcgaggccgucgaggacucccgguucugggagcucguggacaaggagcgcaaccugcaccuggaggggaagugcgagaccugcgucuacaacaugaugggcaagcgggagaagaagcucggggaguucggcaaggccaaggggagccgcgccaucugguacauguggcugggcgcgcgguuccuggaguucgaggcccucggcuuccugaacgaggaccacugguucucccgcgagaacagccuguccgggguggagggcgaggggcuccacaagcugggcuacauccugcgggacgugagcaagaaggagggcggggccauguacgccgacgacacggcgggcugggacacccgcaucacccucgaggaccugaagaacgaggagauggucaccaaccacauggagggggagcacaagaagcuggccgaggccaucuucaagcucacguaccagaacaagguggugcggguccagcgccccacgccccggggcaccgugauggacaucaucagccgccgggaccagcgcggguccggccagguggggaccuacggccugaacacguucaccaacauggaggcccagcugauccggcagauggagggcgagggggucuucaagaacauccagcaccucaccgugaccgaggagguggccguccagaacuggcuggcgcgcgugggccgcgagcggcugagccgcauggccaucuccggggacgacugcguggucaagccccucgacgaccgguucgccaacgcccugacggcccugaacgacaugggcaagauccgcaaggacauccagcagugggagccgagcaagggcuggaacgacuggacccaggugcccuucugcucccaccacuuccacgagcucaucaugaaggacgggcgggugcuggucgugcccugccgcaaccaggacgagcugaucggccgggcgcgcaucagccagggggccggcuggucccuccgggagaccgccugccugggcaagagcuacgcccagauguggucccugauguacuuccaccgccgggaccuccgccuggccgcgaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcggcucccugaucgggcugaccagccgggccaccugggcgaagaacauccaggccgccaucaaccaggugcgcucccucaucggcaacgaggaguacaccgacuacaugccgagcaugaagcgguuccgccgcgaggaggaggaggccggggugcugugguga

SEQ ID NO: 9341 - RNA, 9876 nt, Artificial Sequence
  derived and/or modified CDS sequence (opt1) from DENV-2__FJ744716__SS-prME
agcgccgggaugaucaucaugcugauccccaccgugauggccuuccaccucaccacccggaacggggagccccacaugaucgucgggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagcggauccugggcuacagccagaucggggccggcguguacaaggagggcaccuuccacaccauguggcacgugacccgcggggccguccucaugcacaagggcaagcggaucgagcccuccugggccgacgugaagaaggaccugaucagcuacgggggcggguggaagcuggagggcgaguggaaggagggcgaggaggugcagguccucgcgcuggagcccgggaagaacccccgcgccgugcagacgaagcccggccuguucaagaccaacaccgggaccaucggcgccgugucccucgacuucagccccgggacguccggcagccccaucaucgacaagaagggcaaggucguggggcuguacggcaacgggguggucacccgguccggcgccuacgugagcgccaucgcgcagaccgagaaguccaucgaggacaaccccgagaucgaggacgacaucuuccgcaagcggcgccugaccaucauggaccugcaccccggcgccgggaagacgaagcgguaccuccccgccaucgugcgcgaggccaucaagcggggccugcgcacccugauccucgcgccgacccgggucguggccgccgagauggaggaggcccugcgcgggcugcccauccgguaccagacccccgccauccgcgcggagcacacgggccgcgagaucguggaccucaugugccacgccaccuucaccaugcggcugcugagccccguccgcgugccgaacuacaaccucaucaucauggacgaggcccacuucaccgaccccgccuccaucgccgcgcggggguacaucagcacgcgcguggagaugggcgaggccgccggcaucuucaugaccgccacgccgcccgggagccgggacccguucccccaguccaacgcccccaucaucgacgaggagcgcgagauccccgagcggagcuggaacuccggccacgagugggucaccgacuucaaggggaagacggugugguucgugccgagcaucaaggcgggcaacgacaucgccgccugccugcgcaagaacgggaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggcgaggagcgcgucauccuggccgggcccaugccggugacccacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgcccgaggggaucaucccgagcauguucgagcccgagcgggagaagguggacgccaucgacggcgaguaccgccugcgcggcgaggcccggaagaccuucgucgaccucaugcgccgcggggaccugcccguguggcuggccuacaagguggccgcggagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcggggcggaagucccugacccucaaccugaucacggagaugggccgccugcccaccuucaugacccagaagacccgggacgcccucgacaaccuggccguccugcgcacggccgaggcgggcgggcgggccuacaaccacgcccucuccgagcugcccgagacccuggagacccuccugcugcucacccugcuggccacggugaccggcgggaucuuccucuuccugaugagcggccgcggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggguuccuggagaagaccaagaaggaccucggccugggguccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccugggcaagggguggccccucuccaagauggacaucggcgucccgcugcuggcgaucgggugcuacagccaggugaaccccaucacccucacggccgcccugcugcuccugguggcccacuacgcgaucaucggccccgggcugcaggccaaggccacccgcgaggcccagaagcgggccgcggccggcaucaugaagaaccccaccgucgacggcaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacgggccccaucuccacccucugggaggggaacccgggccgguucuggaacaccaccaucgcggugagcauggccaacaucuuccgcggguccuaccuggccggcgccggccuccucuucagcaucaugaagaacacgaccaacacccgccgggggaccggcaacaucggggagacgcugggcgagaaguggaagucccgccugaacgcccucggcaagagcgaguuccagaucuacaagaaguccgggauccaggaggucgaccggacccuggcgaaggagggcaucaagcgcggggagaccgaccaccacgccgugagccggggcuccgccaagcugcgcugguucguggagcggaacauggucacccccgaggggaaggugguggaccucggcugcggccgcgggggcuggagcuacuacugcgggggccugaagaacguccgggaggugaaggggcugacgaagggcggccccgggcacgaggagcccaucccgauguccaccuacggcuggaaccucgugcgccugcagagcggggucgacguguucuucaucccgcccgagaagugcgacacccugcucugcgacaucggcgaguccagccccaacccgaccguggaggccgggcggacgcugcgcguccugaaccucguggagaacuggcugaacaacaacacccaguucugcaucaaggugcugaaccccuacaugcccuccgucaucgagaagauggaggcgcugcagcggaaguacggcggcgcccucgugcgcaacccgcugagccggaacagcacccacgagauguacuggguguccaacgccagcgggaacaucgucuccagcgugaacaugaucucccgcaugcugaucaaccgguucaccaugcgccacaagaaggccaccuacgagcccgacguggaccucggcagcgggacgcggaacaucggcaucgaguccgagguccccaaccuggacaucaucgggaagcgcaucgagaagaucaagcaggagcacgagaccagcuggcacuacgaccaggaccaccccuacaagaccugggccuaccacggcuccuacgagaccaagcagacgggcagcgcguccagcauggugaacggggugguccgccugcucaccaagccgugggacgugcugcccaccgugacccagauggccaugacggacaccacccccuucggccagcagcgggucuucaaggagaagguggacacccgcacgcaggagcccaaggaggggaccaagaagcugaugaagaucaccgccgaguggcucuggaaggagcugggcaagaagaagaccccgcggaugugcacgcgcgaggaguucacccggaaggugcgcuccaacgccgcccugggcgcgaucuucaccgacgagaacaaguggaaguccgcccgggaggccgucgaggacucccgcuucugggagcucguggacaaggagcggaaccugcaccuggaggggaagugcgagaccugcgucuacaacaugaugggcaagcgcgagaagaagcucggggaguucggcaaggccaaggggagccgggccaucugguacauguggcugggcgcgcgcuuccuggaguucgaggcccucggcuuccugaacgaggaccacugguucucccgggagaacagccuguccgggguggagggcgaggggcuccacaagcugggcuacauccugcgcgacgugagcaagaaggagggcggggccauguacgccgacgacacggcgggcugggacacccggaucacccucgaggaccugaagaacgaggagauggucaccaaccacauggagggggagcacaagaagcuggccgaggccaucuucaagcucacguaccagaacaagguggugcgcguccagcggcccacgccccggggcaccgugauggacaucaucagccggcgcgaccagcggggguccggccagguggggaccuacggccugaacacguucaccaacauggaggcccagcugauccgccagauggagggcgagggggucuucaagaacauccagcaccucaccgugaccgaggagguggccguccagaacuggcuggcgcgcgugggccgggagcgccugagccggauggccaucuccggggacgacugcguggucaagccccucgacgaccgcuucgccaacgcccugacggcccugaacgacaugggcaagauccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcggcucccugaucgggcugaccagccgcgccaccugggcgaagaacauccaggccgccaucaaccaggugcggucccucaucggcaacgaggaguacaccgacuacaugccgagcaugaagcgcuuccgccgggaggaggaggaggccggggugcugugguga

SEQ ID NO: 9342 - RNA, 9876 nt, Artificial Sequence
  derived and/or modified CDS sequence (opt1) from DENV-2__FJ744718__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcagcccggggcgguucuggaacaccaccaucgcgguguccauggccaacaucuuccgcggcagcuaccuggccggcgccgggcuccucuucuccaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugacgaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgaccguggaggccggccggacgcugcgcguccugaaccucguggagaacuggcugaacaacaacacccaguucugcaucaaggugcugaaccccuacaugcccagcgucaucgagaagauggaggcgcugcagcggaaguacggcggggcccucgugcgcaacccgcugagccggaacuccacccacgagauguacugggugagcaacgccuccggcaacaucgucagcuccgugaacaugaucagccgcaugcugaucaaccgguucaccaugcgccacaagaaggccaccuacgagcccgacguggaccucggguccggcacgcggaacaucgggaucgagagcgagguccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgcgagcuccauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcagcaacgccgcccugggggcgaucuucaccgacgagaacaaguggaaguccgcccgggaggccgucgaggacagccgcuucugggagcucguggacaaggagcggaaccugcaccuggagggcaagugcgagaccugcgucuacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucucccggcgcgaccagcggggcagcggccagguggggaccuacggccugaacacguucaccaacauggaggcccagcugauccgccagauggagggggagggcgucuucaagaacauccagcaccucaccgugaccgaggagguggccguccagaacuggcuggcgcggguggggcgcgagcgccugucccggauggccaucagcggcgacgacugcguggucaagccccucgacgaccgcuucgccaacgcccugacggcccugaacgacaugggcaagauccggaaggacauccagcagugggagccguccaagggguggaacgacuggacccaggugcccuucugcagccaccacuuccacgagcucaucaugaaggacggccgcgugcuggucgugcccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggucccgaccucccgcacgaccuggagcauccacgccaagcacgaguggaugaccaccgaggacaugcugaccguguggaaccggguguggauccgcgagaaccccuggauggaggacaagacgcccgucgaguccugggaggagauccccuaccucggcaagcgggaggaccaguggugcgggagccugaucggccugaccucccgcgccaccugggcgaagaacauccaggccgccaucaaccaggugcggagccucaucgggaacgaggaguacaccgacuacaugccgagcaugaagcgcuuccggcgcgaggaggaggaggccggcgugcugugguga

SEQ ID NO: 9343 - RNA, 9876 nt, Artificial Sequence
  derived and/or modified CDS sequence (opt1) from DENV-2__FJ744722__SS-prME
agcgugggcaugaucaucaugcugauccccaccgugauggcguuccaccucaccacccgcaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacagcaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggccaagcugacgaacaccaccaccgagucccgcugccccacgcagggggagcccaaccugaaggaggagcaggacaagcgguucgugugcaagcacagcaugguggaccgcggcuggggcaacgggugcggccucuucgggaagggcgggaucgugaccugcgccauguucacgugcaagaagaacauggagggcaagaucgugcagcccgagaaccuggaguacaccaucguggucacgccccacuccggcgaggagcacgccguggggaacgacaccggcaagcacgggaaggagaucaaggugaccccgcagagcuccaucaccgaggcggagcugaccggcuacgggacggucaccauggagugcagcccccggaccggccucgacuucaacgagauggugcugcugcagauggagaacaaggccuggcucgugcaccgccagugguuccuggaccugccccuccccuggcugccgggcgccgacacccagggguccaacuggauccagaaggagacgcuggucaccuucaagaacccccacgccaagaagcaggacguggucgugcucggcagccaggagggggccaugcacaccgcgcugaccggcgccacggagauccagaugagcuccgggaaccuccuguucaccggccaccugaagugccggcugcgcauggacaagcuccagcugaagggcaugagcuacuccaugugcaccgggaaguucaagguggucaaggagaucgccgagacccagcacggcacgaucgugauccgggugcaguacgagggggacggcagccccugcaagauccccuucgagaucauggaccuggagaagcgcuacguccucggccggcugaucaccgugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagaccacgaugcgcggcgccaagcgcauggcgauccugggcgacaccgccugggacuucgggucccugggcgggguguucaccagcaucggcaaggcccuccaccaggucuucggggccaucuacggcgccgcguucuccggcgugagcuggaccaugaagauccugaucggggugaucaucacguggaucggcaugaacucccggagcaccucccugagcgucucccuggugcucgugggggucgugacccuguaccugggcgugaugguccaggccgacagcgggugcgugguguccuggaagaacaaggagcucaagugcggcagcggcaucuucaucaccgacaacguccacacguggaccgagcaguacaaguuccagcccgagagccccuccaagcuggccagcgccauccagaaggcgcaggaggaggggaucugcggcauccgcuccgugacccggcuggagaaccucauguggaagcagaucacccccgagcugaaccacauccuggccgagaacgaggugaagcucacgaucaugaccggggacaucaagggcaucaugcaggccgggaagcgcagccugcggccgcagcccaccgagcugaaguacuccuggaagaccuggggcaaggccaagaugcucagcacggagucccacaaccagaccuuccugaucgacggccccgagaccgccgagugcccgaacaccaaccgcgcguggaacagccuggaggucgaggacuacggguucggcguguucacgaccaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgccggccccuggcaccuggggaagcuggagauggacuucgacuucugcgacggcacgaccgucguggugaccgaggacugcgggaaccggggccccucccuccgcaccacgaccgcgagcggcaagcugaucaccgaguggugcugccggagcugcacccugcccccgcuccgcuaccgcggggaggacggcugcugguacgggauggagauccgcccccugaaggagaaggaggagaaccuggucaacucccucgugacggccggccacgggcaggucgacaacuucagccugggcguccugggcauggcccucuuccuggaggagaugcugcggacccgcguggggaccaagcacgccauccuccugguggcggucuccuucgugacccugaucacgggcaacaugagcuucaaggaccucgggcggguggucgugauggugggcgccaccaugaccgacgacaucgggaugggcgucaccuaccuggcccugcucgccgccuucaaggugcgccccacguucgcggccggccuguuccugcggaagcucaccuccaaggagcugaugaugaccaccaucgggaucgugcugcucagccaguccacgauccccgagaccauccuggagcugaccgacgcccucgcccugggcaugaugguccugaagauggugcgcgacauggagaaguaccagcucgccgucaccaucauggcgauccugugcgugccgaacgccgugauccugcagaacgccuggaaggucagcugcacgauccucgccgugguguccgucagcccccugcugcucaccuccagccagcagaagaccgacuggaucccccuggcccugaccaucaaggggcucaaccccacggcgaucuuccugaccacccugucccgcaccaacaagaagcggagcuggccgcucaacgaggccaucauggccgugggcaugguguccauccuggccagcucccugcucaagaacgacauccccaugacgggcccccuggucgccgggggccugcucaccgugugcuacgugcugaccgggcgcagcgccgaccuggagcucgagcgggccaccgacgucaagugggaggaccaggccgagaucuccggcagcagccccauccuguccaucacgaucagcgaggacggguccaugagcaucaagaacgaggaggaggagcagacccugaccauccucauccgcaccggccugcuggugaucuccggccucuucccggugagcauccccaucaccgccgcggccugguaccugugggaggucaagaagcagcgggccggggugcugugggacgugcccagcccgccgcccaugggcaaggccgagcucgaggacggggccuaccgcaucaagcagcggggcauccugggguacagccagaucggcgcgggcgucuacaaggaggggacguuccacaccauguggcacgugacccgcggcgccgugcugacccacaaggggaagcggaucgagcccuccugggccgacgucaagaaggaccucaucagcuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugucccuggacuucagccccggcacguccggcagccccaucaucgacaagaaggggaagguggucggccucuacgggaacggcguggugacccgguccggcgccuacgucagcgccaucgcccagaccgagaaguccaucgaggacaaccccgacaucgaggacgacaucuuccgcaagcggcgccugaccaucauggaccugcaccccggggccggcaagacgaagcgguaccugcccgcgaucgugcgcgaggccaucaagcgggggcuccgcacccugauccuggccccgacccggguggucgccgcggagauggaggaggcccuccgcggccugcccauccgguaccagacccccgccauccgcgccgagcacacggggcgcgagaucguggaccugaugugccacgccaccuucaccaugcggcuccugagccccgugcgcgucccgaacuacaaccugaucaucauggacgaggcgcacuucaccgaccccgccuccaucgccgcccggggcuacaucagcacgcgcguggagaugggcgaggccgcggggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggucugguucgugccgagcaucaaggccgggaacgacaucgccgcgugccuccgcaagaacggcaagaaggugauccagcugucccggaagaccuucgacagcgaguacgucaagacccgcaccaacgacugggacuucguggugacgaccgacaucuccgagaugggcgccaacuucaaggccgagcgggucaucgacccccgccggugcaugaagcccgugauccugaccgacggggaggagcgcgugauccucgccggccccaugccggucacccacagcuccgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgggagaagguggacgccaucgacggcgaguaccgccugcgcggggaggcgcggaagaccuucguggaccugaugcgccggggcgaccuccccgucuggcuggccuacaagguggccgccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcgcgcaucuacuccgacccccuggcccucaaggaguucaaggaguucgccgccggccggaagucccugacccugaaccucaucacggagaugggccgccugcccaccuucaugacccagaagacccgggacgcccuggacaaccucgcggugcugcacacggccgaggccgggggccgcgccuacaaccacgcgcuguccgagcuccccgagacccuggagacccugcuccugcugacccuccuggccaccgucaccgggggcaucuuccuguuccucaugagcggccgggggaucggcaagaugacccuggggaugugcugcaucgugaccgccuccauccugcucugguacgcccagauccagccgcacuggaucgccgcgagcaucauccuggaguucuuccugaucgugcuccugauccccgagcccgagaagcagcgcacgccccaggacaaccagcugacguacgucgugaucgccauccucaccguggucgccgccaccauggccaacgagaugggcuuccuggagaagaccaagaaggaccuggggcucggcuccaucgcgacgcagcagccggagagcaacauccuggacaucgaccugcggcccgccuccgccuggacccucuacgccguggccaccaccuucgugacgcccaugcugcgccacagcaucgagaacagcuccgucaacgugagccugaccgcgaucgccaaccaggccaccgugcucaugggccuggggaagggcuggccccuguccaagauggacaucggggccccgcuccuggccaucggcugcuacagccaggucaaccccaucacccugacggcggcccuccugcugcucguggcccacuacgccaucaucgggcccggccugcaggcgaaggccacccgggaggcccagaagcgcgccgccgcgggcaucaugaagaaccccaccguggacgggaucaccgucaucgaccuggacccgauccccuacgaccccaaguucgagaagcagcucggccaggugaugcugcuggugcucugcgucacccaggugcugaugaugcggaccaccugggcccugugcgaggcccucacccuggccacggggcccaucuccacccugugggagggcaacccggggcgcuucuggaacaccaccaucgccgugagcauggcgaacaucuuccggggcuccuaccucgccggcgccgggcugcuguucagcaucaugaagaacacgaccaacucccgccgcggcaccgggaacaucggcgagacccucggcgagaaguggaagucccggcugaacgcccuggggaaguccgaguuccagaucuacaagaaguccggcauccaggaggucgaccgcacgcucgccaaggaggggaucaagcggggcgagaccgaccaccacgcggugucccgcgggagcgccaagcugcggugguucguggagcgcaacauggucacccccgagggcaaggugguggaccugggcugcgggcggggcgggugguccuacuacugcggcgggcucaagaacguccgcgaggugaagggccugaccaagggcgggcccggccacgaggagcccaucccgaugagcacguacggguggaaccuggugcggcuccaguccggcgucgacguguucuucaucccgcccgagaagugcgacacccugcugugcgacaucggggagagcucccccaacccgaccguggaggccggccgcacccuccggguccugaaccugguggagaacuggcucaacaacaacacccaguucugcaucaaggugcugaaccccuacaugcccagcgucaucgagaagauggagacgcugcagcgcaaguacggcggggcccuggugcggaacccgcucagccgcaacuccacccacgagauguacugggugagcaacgcguccggcaacaucgucagcuccgugaacaugaucagccggaugcugaucaaccgcuucaccaugcggcacaagaaggccaccuacgagcccgacguggaccugggguccggcacgcgcaacaucgggaucgagagcgagauccccaaccucgacaucaucggcaagcggaucgagaagaucaagcaggagcacgagaccuccuggcacuacgaccaggaccaccccuacaagaccugggccuaccacggcagcuacgagaccaagcagacgggguccgccagcuccauggucaacggcguggugcgccugcugaccaagccgugggacguccuccccaccgugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagaccccgcgcaugugcacgcgggaggaguucacccgcaaggugcggagcaacgccgcccugggggccaucuucaccgacgagaacaaguggaaguccgcccgcgaggcggucgaggacagccgguucugggagcugguggacaaggagcgcaaccuccaccuggagggcaagugcgagaccugcguguacaacaugauggggaagcgggagaagaagcugggcgaguucgggaaggccaagggcucccgcgccaucugguacauguggcucggcgcccgguuccuggaguucgaggcccugggguuccucaacgaggaccacugguucagccgcgagaacucccugagcggcgucgagggggagggccugcaccggcucggguacauccugcgcgacgugagcaagaaggagggcggcgcgauguacgccgacgacacggccgggugggacacccggaucacccuggaggaccucaagaacgaggagauggugaccaaccacauggagggcgagcacaagaagcuggccgaggcgaucuucaagcugacguaccagaacaaggucgugcgcgugcagcggcccacgccccgggggaccgucauggacaucaucucccggcgcgaccagcggggcagcggccagguggggaccuacggccucaacacguucaccaacauggaggcccagcugauccgccagauggagggggagggcguguucaagaacauccagcaccugaccgucaccgaggagaucgccgugcagaacuggcucgcccgcguggggcgggagcgccugucccggauggccaucagcggcgacgacugcgucgugaagccccuggacgaccgcuucgcguccgcccucacggcccugaacgacaugggcaagauccggaaggacauccagcagugggagccgagccgcggguggaacgacuggacccaggugcccuucugcucccaccacuuccacgagcugaucaugaaggacggccggguccucguggugcccugccgcaaccaggacgagcugaucgggcgggcccgcaucagccagggcgccggguggucccugcgggagaccgcgugccucggcaagagcuacgcccagauguggucccugauguacuuccaccgccgggaccugcgccucgccgccaacgccaucugcagcgcgguccccucccacugggugccgaccagccggaccacgugguccauccacgccaagcacgaguggaugaccaccgaggacaugcugaccguguggaaccgcgucuggauccaggagaaccccuggauggaggacaagacgcccguggagagcugggaggagauccccuaccugggcaagcgggaggaccaguggugcgggucccucaucggccugaccagccgcgccaccugggccaagaacauccagguggccaucaaccagguccggagccugaucgggaacgaggaguacaccgacuacaugccguccaugaagcgcuuccgccgggaggaggaggaggcgggcgugcucugguga

SEQ ID NO: 9344 - RNA, 9876 nt, Artificial Sequence
  derived and/or modified CDS sequence (opt1) from DENV-2__FJ744723__SS-prME
agcgugggcaugaucaucaugcugauccccaccgugauggcguuccaccucaccacccgcaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacuccaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcacgcucaucuucauccugcugaccgccguggcccccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggcgaagcagcccgccacccuccggaaguacugcaucgaggccaagcugacgaacaccaccaccgagucccgcugccccacgcagggggagcccagccugaaggaggagcaggacaagcgguucgugugcaagcacuccaugguggaccgcggcuggggcaacgggugcggccucuucgggaagggcgggaucgugaccugcgccauguucacgugcaagaagaacauggagggcaagaucgugcagcccgagaaccuggaguacaccaucguggucacgccccacagcggcgaggagcacgccguggggaacgacaccggcaagcacgggaaggagaucaaggugaccccgcaguccagcaucaccgaggcggagcugaccggcuacgggacggucaccauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacgcuggucaccuucaagaacccccacgccaagaagcaggacguggucgugcucggcagccaggagggggccaugcacaccgcgcugaccggcgccacggagauccagauguccagcgggaaccuccuguucaccggccaccugaagugccggcugcgcauggacaagcuccagcugaagggcauguccuacagcaugugcaccgggaaguucaagguggucaaggagaucgccgagacccagcacggcacgaucgugauccgggugcaguacgagggggacggcucccccugcaagauccccuucgagaucauggaccuggagaagcgcuacguccucggccggcugaucaccgugaacccgaucgugaccgagaaggacagccccgucaacaucgaggccgagccgcccuucggggacuccuacaucaucaucggcguggagccggggcagcugaagcucaacugguucaagaagggcagcuccaucgggcagauguucgagaccacgaugcgcggcgccaagcgcauggcgauccugggcgacaccgccugggacuucgggagccugggcgggguguucaccuccaucggcaaggcccuccaccaggucuucggggccaucuacggcgccgcguucagcggcguguccuggaccaugaagauccugaucggggugaucaucacguggaucggcaugaacagccgguccaccagccuguccgucagccuggugcucgugggggucgugacccuguaccugggcgugaugguccaggccgacuccgggugcguggugagcuggaagaacaaggagcucaagugcggcagcggcaucuucaucaccgacaacguccacacguggaccgagcaguacaaguuccagcccgagucccccagcaagcuggccuccgccauccagaaggcgcaggaggaggggaucugcggcauccgcagcgugacccggcuggagaaccucauguggaagcagaucacccccgagcugaaccacauccuggccgagaacgaggugaagcucacgaucaugaccggggacaucaagggcaucaugcaggccgggaagcgcucccugcggccgcagcccaccgagcugaaguacagcuggaagaccuggggcaaggccaagaugcucuccacggagagccacaaccagaccuuccugaucgacggccccgagaccgccgagugcccgaacaccaaccgcgcguggaacucccuggaggucgaggacuacggguucggcguguucacgaccaacaucuggcucaagcugaaggagaagcaggacgccuucugcgacagcaagcugauguccgccgccaucaaggacaaccgggccgugcacgcggacaugggguacuggaucgagagcgcccucaacgacaccuggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgccggccccuggcaccuggggaagcuggagauggacuucgacuucugcgacggcacgaccgucguggugaccgaggacugcgggaaccggggccccagccuccgcaccacgaccgcgagcggcaagcugaucaccgaguggugcugccgguccugcacccugcccccgcuccgcuaccgcggggaggacggcugcugguacgggauggagauccgcccccugaaggagaaggaggagaaccuggucaacagccucgugacggccggccacgggcaggucgacaacuucucccugggcguccugggcauggcccucuuccuggaggagaugcugcggacccgcguggggaccaagcacgccauccuccugguggcggucagcuucgugacccugaucacgggcaacauguccuucaaggaccucgggcggguggucgugauggugggcgccaccaugaccgacgacaucgggaugggcgucaccuaccuggcccugcucgccgccuucaaggugcgccccacguucgcggccggccuguuccugcggaagcucaccagcaaggagcugaugaugaccaccaucgggaucgugcugcucucccagagcacgauccccgagaccauccuggagcugaccgacgcccucgcccugggcaugaugguccugaagauggugcgcgacauggagaaguaccagcucgccgucaccaucauggcgauccugugcgugccgaacgccgugauccugcagaacgccuggaaggucuccugcacgauccucgccguggugagcgucagcccccugcugcucaccagcucccagcagaagaccgacuggaucccccuggcccugaccaucaaggggcucaaccccacggcgaucuuccugaccacccugagccgcaccaacaagaagcgguccuggccgcucaacgaggccaucauggccgugggcauggugagcauccuggccuccagccugcucaagaacgacauccccaugacgggcccccuggucgccggcgggcugcucaccgugugcuacgugcugaccgggcgcuccgccgaccuggagcucgagcgggccaccgacgucaagugggaggaccaggccgagaucagcgggagcucccccauccugagcaucacgaucuccgaggacgggagcauguccaucaagaacgaggaggaggagcagacccugaccauccucauccgcaccggccugcuggugaucagcggccucuucccgguguccauccccaucaccgccgcggccugguaccugugggaggucaagaagcagcgggccggggugcugugggacgugcccuccccgccgcccaugggcaaggccgagcucgaggacggggccuaccgcaucaagcagcggggcauccugggguacucccagaucggcgcgggcgucuacaaggaggggacguuccacaccauguggcacgugacccgcggcgccgugcugacccacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucaucgacaagaaggggaagguggucggccucuacgggaacggcguggugacccggagcggcgccuacgucuccgccaucgcccagaccgagaaguccaucgaggacaaccccgacaucgaggacgacaucuuccgcaagcggcgccugaccaucauggaccugcaccccggggccggcaagacgaagcgguaccugcccgcgaucgugcgcgaggccaucaagcgggggcuccgcacccugauccuggccccgacccggguggucgccgcggagauggaggaggcccuccgcggccugcccauccgguaccagacccccgccauccgcgccgagcacacggggcgcgagaucguggaccugaugugccacgccaccuucaccaugcggcuccugucccccgugcgcgucccgaacuacaaccugaucaucauggacgaggcgcacuucaccgaccccgccagcaucgccgcccggggcuacaucagcacgcgcguggagaugggcgaggccgcggggaucuucaugaccgccacgccgcccggcucccgggacccguucccccagagcaacgcccccaucaucgacgaggagcgcgagauccccgagcgguccuggaacagcgggcacgagugggugaccgacuucaagggcaagacggucugguucgugccguccaucaaggccgggaacgacaucgccgcgugccuccgcaagaacggcaagaaggugauccagcugagccggaagaccuucgacuccgaguacgucaagacccgcaccaacgacugggacuucguggugacgaccgacaucagcgagaugggcgccaacuucaaggccgagcgggucaucgacccccgccggugcaugaagcccgugauccugaccgacggggaggagcgcgugauccucgccggccccaugccggucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgccaucgacggcgaguaccgccugcgcggggaggcgcggaagaccuucguggaccugaugcgccggggcgaccuccccgucuggcuggccuacaagguggccgccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcgcgcaucuacagcgacccccuggcccucaaggaguucaaggaguucgccgccggccggaagucccugacccugaaccucaucacggagaugggccgccugcccaccuucaugacccagaagacccgggacgcccuggacaaccucgcggugcugcacacggccgaggccgggggccgcgccuacaaccacgcgcugagcgagcuccccgagacccuggagacccugcuccugcugacccuccuggccaccgucaccgggggcaucuuccuguuccucauguccggccgggggaucggcaagaugacccuggggaugugcugcaucgugaccgccagcauccugcucugguacgcccagauccagccgcacuggaucgccgcguccaucauccuggaguucuuccugaucgugcuccugauccccgagcccgagaagcagcgcacgccccaggacaaccagcugacguacgucgugaucgccauccucaccguggucgccgccaccauggccaacgagaugggcuuccuggagaagaccaagaaggaccuggggcucggcagcaucgcgacgcagcagccggaguccaacauccuggacaucgaccugcggcccgccagcgccuggacccucuacgccguggccaccaccuucgugacgcccaugcugcgccacagcaucgagaacuccagcgucaacgugucccugaccgcgaucgccaaccaggccaccgugcucaugggccuggggaagggcuggccccugagcaagauggacaucggggccccgcuccuggccaucggcugcuacucccaggucaaccccaucacccugacggcggcccuccugcugcucguggcccacuacgccaucaucgggcccggccugcaggcgaaggccacccgggaggcccagaagcgcgccgccgcgggcaucaugaagaaccccaccguggacgggaucaccgucaucgaccuggacccgauccccuacgaccccaaguucgagaagcagcucggccaggugaugcugcuggugcucugcgucacccaggugcugaugaugcggaccaccugggcccugugcgaggcccucacccuggccacggggcccaucagcacccugugggagggcaacccggggcgcuucuggaacaccaccaucgccguguccauggcgaacaucuuccggggcagcuaccucgccggcgccgggcugcuguucuccaucaugaagaacacgaccaacagccgccgcggcaccgggaacaucggcgagacccucggcgagaaguggaagucccggcugaacgcccugggcaagagcgaguuccagaucuacaagaaguccggcauccaggaggucgaccgcacgcucgccaaggaggggaucaagcggggcgagaccgaccaccacgcggugagccgcggguccgccaagcugcggugguucguggagcgcaacauggucacccccgagggcaaggugguggaccugggcugcgggcggggcggguggagcuacuacugcggcgggcucaagaacguccgcgaggugaagggccugaccaagggcgggcccggccacgaggagcccaucccgauguccacguacggguggaaccuggugcggcuccagagcggcgucgacguguucuucaucccgcccgagaagugcgacacccugcugugcgacaucggggaguccagccccaacccgaccguggaggccggccgcacccuccggguccugaaccugguggagaacuggcucaacaacaacacccaguucugcaucaaggugcugaaccccuacaugcccagcgucaucgagaagauggagacgcugcagcgcaaguacggcggggcccuggugcggaacccgcucucccgcaacagcacccacgagauguacuggguguccaacgcgagcggcaacaucgucuccagcgugaacaugaucucccggaugcugaucaaccgcuucaccaugcggcacaagaaggccaccuacgagcccgacguggaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcugaccaagccgugggacguccuccccaccgugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagaccccgcgcaugugcacgcgggaggaguucacccgcaaggugcgguccaacgccgcccugggggccaucuucaccgacgagaacaaguggaaguccgcccgcgaggcggucgaggacucccgguucugggagcugguggacaaggagcgcaaccuccaccuggagggcaagugcgagaccugcguguacaacaugauggggaagcgggagaagaagcugggcgaguucgggaaggccaagggcagccgcgccaucugguacauguggcucggcgcccgguuccuggaguucgaggcccugggguuccucaacgaggaccacugguucucccgcgagaacagccugagcggcgucgagggggagggccugcaccggcucggguacauccugcgcgacguguccaagaaggagggcggcgcgauguacgccgacgacacggccgggugggacacccggaucacccuggaggaccucaagaacgaggagauggugaccaaccacauggagggcgagcacaagaagcuggccgaggcgaucuucaagcugacguaccagaacaaggucgugcgcgugcagcggcccacgccccgggggaccgucauggacaucaucagccggcgcgaccagcggggcuccggccagguggggaccuacggccucaacacguucaccaacauggaggcccagcugauccgccagauggagggggagggcguguucaagaacauccagcaccugaccgucaccgaggagacggccgugcagaacuggcucgcccgcguggggcgggagcgccugagccggauggccaucuccggcgacgacugcgucgugaagccccuggacgaccgcuucgcgagcgcccucaccgcccugaacgacaugggcaagauccggaaggacauccagcagugggagccgucccgcggguggaacgacuggacccaggugcccuucugcagccaccacuuccacgagcugaucaugaaggacggccggguccucguggugcccugccgcaaccaggacgagcugaucgggcgggcccgcaucucccagggcgccggguggagccugcgggagaccgcgugccucggcaaguccuacgcccagauguggagccugauguacuuccaccgccgggaccugcgccucgccgccaacgccaucugcuccgcgguccccagccacugggugccgaccucccggacgaccuggagcauccacgccaagcacgaguggaugaccaccgaggacaugcugacgguguggaaccgcgucuggauccaggagaaccccuggauggaggacaagacccccguggaguccugggaggagauccccuaccugggcaagcgggaggaccaguggugcgggagccucaucggccugaccagccgcgccaccugggccaagaacauccagguggccaucaaccagguccggucccugaucgggaacgaggaguacacggacuacaugccgagcaugaagcgcuuccgccgggaggaggaggaggcgggcgugcucugguga

SEQ ID NO: 9345 - RNA, 9876 nt, Artificial Sequence
  derived and/or modified CDS sequence (opt1) from DENV-2__FJ744724__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaucguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccgucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucguggugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacgggcagaucgacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcgacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgcggucagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgaggugcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcggguggggcgcgagcgccugagccggauggccaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccagaccgccaucaaccaggugcggucccucaucgggaacgaggaguacacggacuacaugccgagcaugaagcgcuuccggcgcgaggaggaggaggccggcguccugugguga

SEQ ID NO: 9346 - RNA, 9876 nt, Artificial Sequence
  derived and/or modified CDS sequence (opt1) from DENV-2__FJ906957__SS-prME
agcgcgggcaugaucaucaugcugauccccaccgugauggccuuccaccucaccacccgcaacggggagccccacaugaucgugagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacaagcaggggagcaacuggauccagaaggagacccuggugaccuucaagaacccccacgcgaagaagcaggacgucgugguccucggcagccaggagggggccaugcacacggcccugaccggcgccaccgagauccagauguccagcgggaaccuccuguucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgcuacgugcucggccggcugaucaccgucaacccgaucgugacggagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacaccgccugggacuucgggagccugggcgggguguucacguccaucggcaaggcccuccaccagguguucggggcgaucuacggcgccgccuucagcggcgucuccuggaccaugaagauccugaucggggugaucaucaccuggaucggcaugaacagccgguccaccagccuguccgugagccugguccucguggggaucgugacgcuguaccugggcgucauggugcaggccgacuccgggugcguggucagcuggaagaacaaggagcucaagugcggcagcggcaucuucaucaccgacaacgugcacaccuggaccgagcaguacaaguuccagcccgagucccccagcaagcuggcguccgccauccagaaggcccaggaggaggggaucugcggcauccgcagcgugacgcggcuggagaaccucauguggaagcagaucacccccgagcugaaccacauccuggccgagaacgaggucaagcucaccaucaugaccggggacaucaagggcaucaugcaggccgggaagcgcucccugcggccgcagcccacggagcugaaguacagcuggaagaccuggggcaaggcgaagaugcucuccaccgagagccacaaccagaccuuccugaucgacggccccgagacggccgagugcccgaacaccaaccgcgccuggaacucccuggagguggaggacuacggguucggcguguucaccaccaacaucuggcucaagcugaaggagaagcaggacgccuucugcgacagcaagcugauguccgccgcgaucaaggacaaccgggccguccacgccgacaugggguacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcgggccccgucucccagcacaacuaccgcccgggguaccacacccagaucgccggccccuggcaccuggggaagcuggagauggacuucgacuucugcgacggcaccaccgugguggucacggaggacugcgggaaccggggccccagccuccgcaccaccaccgccagcggcaagcugaucacggaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccuguuccuggaggagaugcugcggacccgcguggggacgaagcacgccauccuccuggucgccgccagcuucgugacccugaucaccggcaacauguccuucaaggaccucgggcggguggucgugauggugggcgccaccaugacggacgacaucgggaugggcgucaccuaccuggcgcugcucgccgccuucaaggugcgccccaccuucgccgccggccugcugcuccggaagcugaccagcaaggagcugaugaugacgaccaucgggaucgugcuccugucccagagcaccauccccgagaccauccuggagcucacggacgcgcuggcccugggcaugaugguccucaagaucgugcgcaacauggagaaguaccagcuggccgugaccaucauggccauccugugcgucccgaacgccgugauccuccagaacgcguggaaggucuccugcaccauccuggccguggugagcgucagcccccugcuccugaccagcucccagcagaagacggacuggaucccccuggcccucaccaucaaggggcugaaccccaccgccaucuuccugaccacgcucagccgcaccaacaagaagcgguccuggccgcugaacgaggcgaucauggccgugggcauggugagcauccuggccuccagccuccugaagaacgacauccccaugaccggcccccuggucgccgggggccuccugaccgugugcuacgugcugacggggcgcuccgccgaccucgagcuggagcgggcgaccgacgucaagugggaggaccaggccgagaucagcggcagcucccccauccugagcaucaccaucuccgaggacgggagcauguccaucaagaacgaggaggaggagcagacccucacgauccugauccgcaccggccugcucgugaucagcggccuguucccgguguccauccccaucaccgccgccgccugguaccugugggaggucaagaagcagcgggcgggggugcucugggacgugcccuccccgccgcccaugggcaaggccgagcuggaggacggggccuaccgcaucaagcagaagggcauccugggguacucccagaucggcgccggcgucuacaaggaggggaccuuccacaccauguggcacgugacgcggggcgccgugcucaugcacaaggggaagcgcaucgagcccagcugggcggacgucaagaaggaccugaucuccuacggcgggggcuggaagcuggagggcgaguggaaggagggggaggagguccaggugcucgcccuggagcccggcaagaacccccgggccguccagaccaagcccgggcuguucaagaccaacaccggcacgaucggggccgugagccucgacuucucccccggcaccagcggcucccccaucaucgacaagaaggggaagguggucggccuguacgggaacggcguggugacccgcagcggcgccuacgucuccgcgaucgcccagaccgagaaguccaucgaggacaaccccgagaucgaggacgacaucuuccggaagcgccggcugacgaucauggaccugcaccccggggccggcaagaccaagcgcuaccuccccgccaucgugcgggaggcgaucaagcgcgggcugcggacccugauccucgccccgacccgcguggucgccgccgagauggaggaggcccugcggggccugcccauccgcuaccagacgcccgcgauccgggccgagcacaccgggcgcgagaucguggaccucaugugccacgccaccuucaccaugcgccugcugucccccgugcgggucccgaacuacaaccucaucaucauggacgaggcccacuucacggaccccgccagcaucgcggcccgcggcuacaucagcacccggguggagaugggcgaggccgccgggaucuucaugaccgccacgccgcccggcucccgcgacccguucccccagagcaacgcgcccaucaucgacgaggagcgggagauccccgagcgcuccuggaacagcgggcacgagugggugacggacuucaagggcaagaccgucugguucgugccguccaucaaggccgggaacgacaucgccgccugccugcggaagaacggcaagaaggugauccagcugagccgcaagaccuucgacuccgaguacgucaagacccggacgaacgacugggacuucguggugaccaccgacaucagcgagaugggcgcgaacuucaaggccgagcgcgucaucgacccccggcgcugcaugaagcccgugauccucaccgacggggaggagcgggugauccuggccggccccaugccggucacgcacuccagcgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgcgagaagguggacgccaucgacggcgaguaccggcugcgcggggaggcccgcaagaccuucguggaccucaugcggcgcggcgaccugcccgucuggcuggccuacaagguggcggccgaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgcggccggccgcaagucccugacgcucaaccugaucaccgagaugggccggcugcccaccuucaugacccagaagacgcgcgacgcccucgacaaccuggccgugcugcacaccgcggaggccgggggccgggccuacaaccacgcccucagcgagcugcccgagacccuggagacccuccugcugcucacgcugcuggccaccgucaccgggggcaucuuccucuuccugauguccggccgcgggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacguggucaucgccauccugaccgugguggcggccaccauggccaacgagaugggcuuccuggagaagacgaagaaggaccucgggcugggcagcaucgccacccagcagccggaguccaacauccuggacaucgaccuccgccccgccagcgcguggacccuguacgccgucgccaccacguucgugacccccaugcugcggcacagcaucgagaacuccagcgugaacgucucccucaccgccaucgccaaccaggcgaccgugcugaugggccuggggaagggcuggccccucagcaagauggacaucggggugccgcugcuggccaucggcugcuacucccaggucaaccccaucacgcucaccgccgcccugcugcuccugguggcgcacuacgccaucaucgggcccggccugcaggccaaggccacccgcgaggcccagaagcgggcggccgccggcaucaugaagaaccccaccguggacgggaucacggucaucgaccucgacccgauccccuacgaccccaaguucgagaagcagcugggccaggugaugcugcucauccugugcgugacccagguccugaugaugcgcaccaccugggcccucugcgaggcccugacgcuggcgaccgggcccaucagcacccucugggagggcaacccggggcgguucuggaacaccacgaucgccguguccauggccaacaucuuccgcggcagcuaccuggccggcgccgggcuccucuucuccaucaugaagaacaccaccaacacccggcgcggcacggggaacaucggcgagacccugggcgagaaguggaagucccgccugaacgcgcucgggaaguccgaguuccagaucuacaagaaguccggcauccaggagguggaccggacccuggccaaggaggggaucaagcgcggcgagaccgaccaccacgccgucucccgggggagcgccaagcugcgcugguucguggagcggaacauggugacgcccgagggcaaggucguggaccucggcugcgggcgcggcgggugguccuacuacugcggcgggcugaagaacgugcgggaggucaagggccugaccaagggcgggcccggccacgaggagcccaucccgaugagcaccuacggguggaaccucgugcgccugcaguccggcguggacgucuucuucaucccgcccgagaagugcgacacccugcucugcgacaucggggagagcucccccaacccgacgguggaggcgggccggacccugcgcgugcugaaccucgucgagaacuggcugaacaacaacacccaguucugcaucaaggugcugaaccccuacaugcccagcgugaucgagaagauggaggcccugcagcggaaguacggcggggcccucguccgcaacccgcugagccggaacuccacccacgagauguacugggugagcaacgccuccggcaacaucgugagcuccgucaacaugaucagccgcaugcugaucaaccgguucaccaugcgccacaagaaggccacguacgagcccgacguggaccucggguccggcacccggaacaucgggaucgagagcgagauccccaaccuggacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggugaacggcgucgugcggcugcucaccaagccgugggacgugcugcccaccgucacgcagauggccaugaccgacaccacccccuucgggcagcagcgcguguucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaagguccgcagcaacgccgcgcugggggccaucuucaccgacgagaacaaguggaaguccgcccgggaggccguggaggacagccgcuucugggagcucguggacaaggagcggaaccugcaccuggagggcaagugcgagacgugcgucuacaacaugauggggaagcgcgagaagaagcucggcgaguucgggaaggccaagggcucccgggcgaucugguacauguggcugggcgcccgcuuccuggaguucgaggcccucggguuccugaacgaggaccacugguucagccgggagaacucccugagcggcguggagggggagggccuccacaagcugggguacauccugcgcgacgucagcaagaaggagggcggcgccauguacgcggacgacaccgccgggugggacacccggaucacccucgaggaccugaagaacgaggagauggugacgaaccacauggagggcgagcacaagaagcuggccgaggccaucuucaagcucaccuaccagaacaaggugguccgcgugcagcggcccacgccccgggggaccgugauggacaucaucucccggcgcgaccagcggggcagcgggcaggucggcacguacggccugaacaccuucaccaacauggaggcccagcugauccgccagauggagggggagggcguguucaagaacauccagcaccucaccgugacggaggagaucgcgguccagaacuggcuggcccggguggggcgcgagcgccugucccggauggccaucagcggcgacgacugcguggucaagccccucgacgaccgcuucgccaacgcccugaccgcgcugaacgacaugggcaagauccggaaggacauccagcagugggagccguccaagggguggaacgacuggacccaggugcccuucugcagccaccacuuccacgagcucaucaugaaggacggccgcgugcuggucgugcccugccggaaccaggacgagcugaucgggcgcgcccggaucucccagggcgccggguggagccuccgcgagaccgccugccugggcaaguccuacgcccagauguggagccugauguacuuccaccggcgcgaccuccggcuggcggccaacgccaucugcuccgccgugcccagccacugggucccgacgucccgcaccaccuggagcauccacgccaagcacgaguggaugaccaccgaggacaugcugacgguguggaaccggguguggauccaggagaaccccuggauggaggacaagacccccgucgaguccugggaggagauccccuaccucggcaagcgcgaggaccaguggugcgggagccugaucggccugaccucccgggcgaccugggccaagaacauccaggccgccaucaaccaggugcgcagccucaucgggaacgaggaguacacggacuacaugccgagcaugaagcgguuccgccgggaggaggaggaggcgggcgugcugugguga

SEQ ID NO: 9347 - RNA, 9876 nt, Artificial Sequence
  derived and/or modified CDS sequence (opt1) from DENV-2__FJ906958__SS-prME
agcgugggcaugaucaucaugcugauccccaccgugauggcguuccaccucaccacccggaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacagcaccagcaccugggucaccuacgggaccugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcgcccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagcacgcgguggggaacgacacgggcaagcacgggaaggagaucaaggugaccccgcaguccagcaucaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacccuggucacguucaagaacccccacgccaagaagcaggacguggucgugcucggcagccaggagggggcgaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggucaaggagaucgccgagacccagcacggcaccaucgugauccgggugcaguacgagggggacggcucccccugcaagguccccuucgagaucauggaccuggagaagcgcuacgugcucggccggcugaucacggugaacccggucgugaccgagaaggacagccccgugaacaucgaggccgagccgcccuucggggacuccuacaucaucaucggcgucgagccggggcagcugaagcucaacugguucaagaagggcagcuccaucgggcagauguucgagaccaccaugcgcggcgcgaagcgcauggccauccugggcgacacggccugggacuucgggagccugggcgggguguucaccuccaucggcaaggcccuccaccagguguucggggccaucuacggcgcggccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggccuccgcgauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggccaagaugcucuccaccgagagccacaaccagacguuccugaucgacggccccgagaccgcggagugcccgaacaccaaccgcgccuggaacucccuggagguggaggacuacggguucggcguguucaccacgaacaucuggcucaagcugaaggagaagcaggacgccuucugcgacagcaagcugauguccgccgccgucaaggacaaccgggcggugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgccggccccgugucccagcacaacuaccgcccgggguaccacacccagaucgcgggccccuggcaccuggggaagcuggagauggacuucgacuucugcgacggcaccacgguggucgugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucaccgccggccagggccagguggacaacuucucccugggcgugcugggcauggcccucuuccuggaggagaugcugcggacgcgcgucgggaccaagcacgcgauccuccugguggccgugagcuucgucacccugaucaccggcaacauguccuucaaggaccucgggcgggugguggucauggugggcgccacgaugaccgacgacaucgggaugggcgugaccuaccuggcccugcucgccgcguucaagguccgccccaccuucgccgccggccugcugcuccggaagcugacgagcaaggagcugaugaugaccaccaucgggaucgugcuccugucccagagcaccauccccgagacgauccuggagcucaccgacgcccuggcccugggcaugaugguccucaagaucgugcgcgacauggagaaguaccagcuggcggugaccaucauggccauccugugcgucccgaacgccgugauccuccagaacgccuggaagguguccugcaccauccuggccgucgugagcgugagcccccugcuccugacgagcucccagcagaagaccgacuggaucccccuggcgcucaccaucaaggggcugaaccccaccgccaucuuccugacgacccucagccgcaccaacaagaagcgguccuggccgcugaacgaggccaucauggccgucggcauggugagcauccuggcguccagccuccugaagaacgacauccccaugaccggcccccugguggccgggggccuccugacggucugcuacgugcugaccgggcgcuccgccgaccucgagcuggagcgggccaccgacgugaagugggaggaccaggccgagaucagcggcagcucccccauccugagcaucaccaucuccgaggacgggagcauguccaucaagaacgaggaggaggagcagacgcucaccauccugauccgcaccggccugcucgucaucagcggccuguucccgguguccauccccaucaccgcggccgccugguaccugugggaggugaagaagcagcgggccgggguccucugggacgugcccuccccgccgcccaugggcaaggccgagcuggaggacggggcguaccgcaucaagcagaagggcauccugggguacucccagaucggcgccggcguguacaaggaggggaccuuccacacgauguggcacgucacccggggcgccgugcucaugcacaaggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggcuguucaagaccaacacgggcaccaucggggccgucagccucgacuucucccccggcaccagcggcucccccaucaucgacaagaaggggaagguggugggccuguacgggaacggcgucgugacccgcagcggcgccuacguguccgccaucgcccagacggagaaguccaucgaggacaaccccgacaucgaggacgacaucuuccggaagcgccggcugaccaucauggaccugcaccccggggcgggcaagaccaagcgcuaccuccccgccaucguccgggaggccaucaagcgcgggcugcggacccugauccucgccccgacgcgcgugguggcggccgagauggaggaggcccugcggggccugcccauccgcuaccagacccccgccauccgggccgagcacaccgggcgcgagaucgucgaccucaugugccacgcgaccuucacgaugcgccugcugucccccgugcgggugccgaacuacaaccucaucaucauggacgaggcccacuucaccgaccccgccagcaucgccgcccgcggcuacaucagcacccgggucgagaugggcgaggcggccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagaccuucgacuccgaguacgccaagacgcggaccaacgacugggacuucguggucaccaccgacaucagcgagaugggcgccaacuucaaggcggagcgcgugaucgacccccggcgcugcaugaagcccgugauccucacggacggggaggagcgggucauccuggccggccccaugccggugacccacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaagguggacgccaucgacggcgaguaccggcugcgcggggaggcccgcaagaccuucgucgaccucaugcggcgcggcgaccugcccguguggcuggccuacaaggucgccgcggaggggaucaacuacgccgaccggcgcuggugcuucgacggcaucaagaacaaccagauccucgaggagaacguggagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaagacccgcgacgcccucgacaaccuggccguccugcacaccgccgaggccggcgggcgggccuacaaccacgcccucagcgagcugcccgagacccuggagacgcuccugcugcucacccugcuggccaccgugaccggcgggaucuuccucuuccugauguccgggcgcgggaucggcaagaugacccuggggaugugcugcaucgugacggccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgacgauggccaacgagaugggcuuccuggagaagaccaagaaggaccucgggcugggcagcaucgccacccagcagccggaguccaacauccuggacaucgaccuccgccccgccagcgccuggacccuguacgcgguggccacgaccuucgucacccccaugcugcggcacagcaucgagaacuccagcgugaacgugucccucaccgccaucgccaaccaggccacgguccugaugggccuggggaagggcuggccccucagcaagauggacaucggggugccgcugcuggcgaucggcugcuacucccaggugaaccccaucacccucaccgccgcccugcugcuccuggucgcccacuacgcgaucaucgggcccggccugcaggccaaggccacccgcgaggcccagaagcgggccgcggccggcaucaugaagaaccccacgguggacgggaucaccgugaucgaccucgacccgauccccuacgaccccaaguucgagaagcagcugggccaggucaugcugcucgugcugugcgugacccagguccugaugaugcgcaccacgugggcccucugcgaggcccugacccuggccaccgggcccaucagcacccucugggagggcaacccggggcgguucuggaacacgaccaucgcgguguccauggccaacaucuuccgcggcagcuaccuggccggcgccgggcuccuguucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggagguggaccggacccuggcgaaggaggggaucaagcgcggcgagacggaccaccacgccgucucccgggggagcgccaagcugcgcugguucguggagcggaacauggugacccccgagggcaaggucguggaccucggcugcgggcgcggcgggugguccuacuacugcggcgggcugaagaacgugcgggaggucaagggccugaccaagggcgggcccggccacgaggagcccaucccgaugagcaccuacggguggaaccucgugcgccugcaguccggcguggacgucuucuucaucccgcccgagaagugcgacacgcugcucugcgacaucggggagagcucccccaacccgaccguggaggccggccggacccugcgcgugcugaaccucgucgagaacuggcugaacaacaacacccaguucugcaucaaggugcugaaccccuacaugcccagcgugaucgagaagauggagacccugcagcggaaguacggcggggcgcucguccgcaacccgcugagccggaacuccacgcacgagauguacugggugagcaacgccuccggcaacaucgugagcuccgucaacaugaucagccgcaugcugaucaaccgguucaccaugcgccacaagaaggccaccuacgagcccgacguggaccucggguccggcacccggaacaucgggaucgagagcgagauccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcggcugcucacgaagccgugggacgugcugcccaccgucacccagauggcgaugaccgacacgacccccuucgggcagcagcgcguguucaaggagaaggucgacacccgcacccaggagcccaaggagggcacgaagaagcugaugaagaucaccgccgaguggcucuggaaggagcugggcaagaagaagaccccgcggaugugcacccgcgaggaguucacgcggaaggugcgcagcaacgccgcccugggggccaucuucaccgacgagaacaaguggaaguccgcgcgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcguggagggggagggccuccacaagcugggguacauccugcgcgacgucagcaagaaggagggcggcgccauguacgccgacgacaccgccgggugggacacgcggaucacccucgaggaccugaagaacgaggagauggugaccaaccacauggagggcgagcacaagcgccuggcggaggccaucuucaagcucaccuaccagaacaaggugguccgggugcagcgccccacgccccgggggaccgugauggacaucaucucccgccgggaccagcgcggcagcgggcaggucggcaccuacggccugaacaccuucacgaacauggaggcccagcugauccggcagauggagggggagggcguguucaagaacauccagcaccucaccgugaccgaggagaucgccguccagaacuggcuggcccgcguggggcgcgagcggcugucccgcauggcgaucagcggcgacgacugcguggucaagccccucgacgaccgguucgccuccgcccugaccgcccugaacgacaugggcaagauccgcaaggacauccagcagugggagccgagccggggguggaacgacuggacgcagguccccuucugcucccaccacuuccacgagcucaucaugaaggacggccgcgugcuggucgugcccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggucccgaccagccgcaccaccugguccauccacgccaagcacgaguggaugacgaccgaggacaugcugaccguguggaaccggguguggauccaggagaaccccuggauggaggacaagacccccgucgagagcugggaggagauccccuaccucggcaagcgcgaggaccaguggugcgggucccugaucggccugacgagccgggccaccugggccaagaacauccaggcggccaucaaccaggugcgcagccucaucgggaacgaggaguacaccgacuacaugccguccaugaagcgguuccgccgcgaggaggaggaggccggcgugcugugguga

SEQ ID NO: 9348 - RNA, 9876 nt, Artificial Sequence
  derived and/or modified CDS sequence (opt1) from DENV-2__FJ898452__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggagguggccgugcagaacuggcuggcgcgggucgggcgcgagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacaccgacuacaugccgagcaugaagcgcuuccggcgcgaggaggaggaggccggcgugcugugguga

SEQ ID NO: 9349 - RNA, 9876 nt, Artificial Sequence
  derived and/or modified CDS sequence (opt1) from DENV-2__GQ868591__SS-prME
uccgccgggaugaucaucaugcugauccccaccgugauggccuuccaccucaccacccgcaacggggagccccacaugaucgucucccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacuccaccagcaccugggugaccuacgggaccugcaccaccaugggcgagcaccggcgcgagaagcgguccgucgcccuggugccccacgugggcauggggcucgagacccgcaccgagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugccccacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucacgccccacagcggcgaggagcacgccguggggaacgacaccggcaagcacgggaaggagaucaagaucacgccgcaguccagcaucaccgaggcggagcugaccggcuacgggaccgugaccauggagugcagcccccggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaacccgaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccuccaccagguguucggggccaucuacggcgccgcguucagcggcgucuccuggaccaugaagauccugaucggggugaucaucaccuggaucggcaugaacagccgguccaccagccuguccgugacgcugguccucguggggaucgugacccuguaccugggcgucauggugcaggccgacagcgggugcguggucuccuggaagaacaaggagcucaagugcggcagcggcaucuucaucaccgacaacgugcacaccuggacggagcaguacaaguuccagcccgagagccccuccaagcuggccagcgccauccagaaggcgcacgaggaggggaucugcggcauccgcuccgugacccggcuggagaaccucauguggaagcagaucacccccgagcugaaccacauccugagcgagaacgaggucaagcucaccaucaugacgggggacaucaagggcaucaugcaggccgggaagcgcucccugcggccgcagcccaccgagcugaaguacagcuggaagaccuggggcaaggccaagaugcucuccaccgagagccacaaccagacguuccugaucgacggccccgagaccgccgagugcccgaacaccaaccgcgccuggaacucccuggagguggaggacuacggguucggcguguucaccacgaacaucuggcucaagcugaaggagaagcaggacgucuucugcgacagcaagcugauguccgcggccaucaaggacaaccgggccgugcacgccgacaugggguacuggaucgagagcgcccucaacgacaccuggaagaucgagaaggcguccuucaucgaggugaagaacugccacuggcccaagagccacacccugugguccaacggcguccuggagagcgagaugaucauccccaagaaccucgccggccccgugucccagcacaacuaccgcccgggguaccacacccagaucaccggccccuggcaccuggggaagcuggagauggacuucgacuucugcgacggcacgaccguggucgugaccgaggacugcgggaaccggggccccagccuccgcaccacgaccgccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucacggccggccacggccagguggacaacuucucccugggcgugcugggcauggcccucuuccuggaggagaugcugcggacccgcgucgggaccaagcacgcgauccuccugguggccgugagcuucgucacccugaucacgggcaacauguccuuccgggaccucgggcgcgugauggugauggucggcgccaccaugaccgacgacaucgggaugggcgugaccuaccuggcccugcucgcggccuucaaggugcgccccacguucgccgccggccugcugcuccggaagcugaccagcaaggagcugaugaugaccaccaucgggaucguccuccugucccagagcacgauccccgagaccauccuggagcucaccgacgcccuggcgcugggcaugauggugcucaagauggugcgcaacauggagaaguaccagcuggccgucaccaucauggccauccugugcgugccgaacgccgucauccuccagaacgccuggaagguguccugcacgauccuggcgguggucagcgugagcccccugcuccugaccagcucccagcagaagaccgacuggaucccccuggcccucaccaucaaggggcugaaccccacggccaucuuccugaccacccucagccggaccuccaagaagcgcagcuggccgcugaacgaggccaucauggccgugggcauggucuccauccuggcgagcucccuccugaagaacgacauccccaugacgggcccccugguggccgggggccuccugaccgugugcuacguccugaccgggcggagcgccgaccucgagcuggagcgcgccgcggacgugaagugggaggaccaggccgagaucagcggcuccagccccauccuguccaucaccaucagcgaggacggguccaugagcaucaagaacgaggaggaggagcagacgcucaccauccugauccggaccggccugcucgugaucuccggccuguucccggucagcauccccaucaccgccgccgccugguaccugugggaggugaagaagcagcgcgcgggggugcucugggacguccccagcccgccgcccaugggcaaggccgagcuggaggacggggccuaccggaucaagcagaagggcauccugggguacagccagaucggcgccggcguguacaaggaggggaccuuccacacgauguggcacgugacccgcggcgccguccucaugcacaaggggaagcggaucgagcccuccugggcggacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacgccggcacgaucggggccgugucccucgacuucagccccggcaccuccggcagccccaucaucgacaagaaggggaaggucgugggccuguacgggaacggcguggucacccgguccggcgcguacgugagcgccaucgcccagaccgagaaguccaucgaggacaaccccgagaucgaggacgacaucuuccgcaagcggcgccugacgaucauggaccugcaccccggggccggcaagaccaagcgguaccuccccgccaucgugcgcgaggcgaucaagcgggggcugcgcacccugauccucgccccgacccgggucguggccgccgagauggaggaggcgcugcgcggccugcccauccgcuaccagacgcccgccauccgggccgagcacaccgggcgcgagaucguggaccucaugugccacgccaccuucaccaugcggcugcugagccccguccgcgugccgaacuacaaccucaucaucauggacgaggcccacuucacggaccccgcgagcaucgccgcccggggcuacaucuccacccgcguggagaugggcgaggccgccgggaucuucaugaccgcgacgccgcccggcagccgggacccguucccccaguccaacgcccccaucaucgacgaggagcgcgagauccccgagcggagcuggaacuccgggcacgagugggucacggacuucaagggcaagaccgugugguucgugccgagcaucaaggccgggaacgacaucgccgccugccugcgcaagaacggcaagaaggucauccagcugucccggaagaccuucgacagcgaguacgugaagacccgcacgaacgacugggacuucguggucaccaccgacaucuccgagaugggcgcgaacuucaaggccgagcgggugaucgacccccgccggugcaugaagcccgugauccucaccgacggggaggagcgcgucauccuggccggccccaugccggugacgcacagcuccgccgcgcagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgccaucgacggcgaguaccggcugcgcggggaggcccggaagaccuucgucgaccucaugcgccggggcgaccugcccguguggcuggcguaccgcguggccgccgaggggaucaacuacgccgaccggcgcuggugcuucgacggcgucaagaacaaccagauccucgaggagaacguggaggucgagaucuggaccaaggagggggagcggaagaagcugaagccgcgcuggcuggacgcccggaucuacuccgacccccucgcgcugaaggaguucaaggaguucgccgccggccgcaagagccugacgcucaaccugaucaccgagaugggccggcugcccaccuucaugacccagaaggcccgcgacgcccucgacaaccuggcggugcugcacacggccgaggccgggggccgggccuacaaccacgcgcucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgccgcgagcaucauccuggaguucuuccucaucguccugcugauccccgagcccgagaagcagcggacgccccaggacaaccagcucacguacguggugaucgccauccugaccgucguggccgccaccauggccaacgagaugggcuuccuggagaagaccaagaaggaccucgggcugggcuccaucgcgacgcagcagccggagagcaacauccuggacaucgaccuccgccccgccagcgccuggacccuguacgccguggccaccaccuucgucacgcccaugcugcggcacuccaucgagaacagcuccgugaacgugagccucaccgcgaucgccaaccaggccaccguccugaugggccuggggaagggcuggccccucuccaagauggacaucggggugccgcugcuggccaucggcugcuacagccaggugaaccccaucacccucacggccgcgcuguuccugcucgucgcccacuacgccaucaucgggcccggccugcaggccaaggcgacccgcgaggcccagaagcgggccgccgccggcaucaugaagaaccccaccguggacgggaucaccgugaucgaccuggacccgauccccuacgaccccaaguucgagaagcagcucggccaggucaugcugcuggugcucugcgugacgcagguccugaugaugcgcaccaccugggcgcugugcgaggcccucacccuggccacggggcccaucuccacccugugggagggcaacccggggcgcuucuggaacaccaccaucgccgugagcauggccaacaucuuccggggcuccuaccucgcgggcgccgggcugcuguucagcaucaugaagaacacgaccaacacccgccggggcaccgggaacaucggcgagacgcucggcgagaaguggaagucccgccugaacgcccuggggaaguccgaguuccagaucuacaagaaguccggcauccaggagguggaccggacccucgccaaggaggggaucaagcgcggcgagaccgaccaccacgccgucagccggggguccgcgaagcugcgcugguucguggagcggaacauggugacccccgagggcaaggucguggaccugggcugcgggcgcggcggguggagcuacuacugcggcgggcucaagaacgugcgggaggucaagggccugacgaagggcgggcccggccacgaggagcccaucccgauguccaccuacggguggaaccuggugcgccuccagagcggcguggacgucuucuucaucccgcccgagaagugcgacacccugcugugcgacaucggggaguccagccccaacccgaccguggaggccggccggacgcuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacccacgagauguacuggguguccaacgcgagcggcaacaucguguccagcgucaacaugaucucccgcaugcugaucaaccgguucaccaugcgcuacaagaaggccaccuacgagcccgacguggaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugguccccauggugacccagauggccaugaccgacacgacccccuucgggcagcagcggguguucaaggagaaggucgacacccgcacccaggagcccaaggagggcacgaagaagcucaugaagaucaccgcggaguggcuguggaaggagcugggcaagaagaagaccccgcggaugugcacccgcgaggaguucacgcggaaggugcgcuccaacgccgcccucggggccaucuucgccgacgagaacaaguggaaguccgcgcgggaggccgucgaggacucccgcuucugggagcugguggacaaggagcggaaccugcaccucgagggcaagugcgagaccugcguguacaacaugauggggaagcgcgagaagaagcugggcgaguucgggaaggccaagggcagccgggccaucugguacauguggcugggcgcccgcuuccucgaguucgaggcgcugggguuccugaacgaggaccacugguucucccgggagaacagccucagcggcgucgagggggagggccugcacaagcugggguacauccuccgcgacguguccaagaaggagggcggcgccauguacgccgacgacaccgccgggugggacacccggaucacgcuggaggaccugaagaacgaggagauggugaccaaccacauggagggcgagcacaagaagcucgcggaggccaucuucaagcugaccuaccagaacaaggucgugcgcgugcagcggcccacgccccgggggacggucauggacaucaucagccggcgcgaccagcgcggcuccggccagguggggaccuacggccugaacaccuucaccaacauggaggcccagcucauccggcagauggagggggagggcguguucaagagcauccagcaccugacgaucaccgaggagaucgccguccagaacuggcuggcccgcguggggcgggagcgccucucccggauggcgaucagcggcgacgacugcguggucaagccccuggacgaccgcuucgccuccgcccugaccgcccucaacgacaugggcaagauccggaaggacauccagcagugggagccgagccgcggguggaacgacuggacccaggugcccuucugcucccaccacuuccacgagcugaucaugaaggacggccgggugcuggucgugcccugccgcaaccaggacgagcucaucgggcgggcccgcaucagccagggcgcgggguggucccugcgggagacggccugccugggcaagagcuacgcccagauguggucccucauguacuuccaccgccgggaccugcgccuggccgccaacgcgaucugcagcgccgugcccucccacugggucccgaccagccggaccaccugguccauccacgccaagcacgaguggaugacgaccgaggacaugcucaccguguggaaccgcguguggauccaggagaaccccuggauggaggacaagacccccgucgagagcugggaggagauccccuaccugggcaagcgggaggaccaguggugcgggagccugaucggccucaccucccgcgccacgugggccaagaacauccaggcggccaucaaccaggugcgcagccugaucgggaacgaggaguacaccgacuacaugccguccaugaagcgguuccgccgggaggaggaggaggccggcgugcugugguga

SEQ ID NO: 9350 - RNA, 9876 nt, Artificial Sequence
  derived and/or modified CDS sequence (opt1) from DENV-2__GQ868542__SS-prME
agcgcgggcaugaucaucaugcugauccccaccgugauggcguuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggacgugcaccaccaccggcgagcaccgccgggagaagcgcuccgucgcccuggugccccacgugggcauggggcucgagacgcggaccgagaccuggaugagcuccgagggcgccuggaagcacgcccagcgcaucgagaccuggauccugcggcacccgggguucacgaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugcaagauccccuucgagaucauggaccuggagaagcgcuacgugcucggccggcugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccgagaccgccgagugcccgaacaccaaccgcgccuggaacucccuggagguggaggacuacggguucggcguguucaccacgaacaucuggcucaagcugaaggagaagcaggacgccuucugcgacagcaagcugauguccgccgcgaucaaggacaaccgggccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccgcccgggguaccacacccagaucgccggccccuggcaccuggggaagcuggagauggacuucgacuucugcgacggcaccacggugguggucaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccuguuccuggaggagaugcugcggacgcgcguggggaccaagcacgccauccuccuggucgccgugagcuucgugacccugaucaccggcaacauguccuucaaggaccucgggcgggucguggugauggucggcgccacgaugaccgacgacaucgggaugggcgugaccuaccuggcccugcucgcggccuucaaggugcgccccaccuucgccgccggccugcugcuccggaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugcuccugacgagcucccagcagaagaccgacuggaucccccuggcccucaccaucaaggggcugaaccccaccgccaucuuccugacgacccucagccgcaccaacaagaagcgguccuggccgcugaacgaggccaucauggcggugggcauggucagcauccuggccuccagccuccugaagaacgacauccccaugaccggcccccugguggccgggggccuccugacggugugcuacguccugaccgggcgcuccgccgaccucgagcuggagcgggccaccgacgugaagugggaggaccaggcggagaucagcggcagcucccccauccugagcaucaccaucuccgaggacgggagcauguccaucaagaacgaggaggaggagcagacgcucaccauccugauccgcaccggccugcucgugaucagcggccuguucccggucuccauccccaucaccgccgccgccugguaccugugggaggugaagaagcagcgggccggggugcucugggacguccccuccccgccgcccaugggcaaggcggagcuggaggacggggccuaccgcaucaagcagaagggcauccugggguacucccagaucggcgccggcguguacaaggaggggaccuuccacacgauguggcacgugacccggggcgccguccucaugcacaaggggaagcgcaucgagcccagcugggccgacgugaagaaggaccugaucuccuacggcgggggcuggaagcuggagggcgaguggaaggagggggaggaggugcagguccucgcgcuggagcccggcaagaacccccgggccgugcagaccaagcccgggcuguucaagaccaacacgggcaccaucggggccgugagccucgacuucucccccggcaccagcggcucccccaucaucgacaagaaggggaaggucgugggccuguacgggaacggcguggucacccgcagcggcgccuacguguccgccaucgcgcagacggagaaguccaucgaggacaaccccgagaucgaggacgacaucuuccggaagcgccggcugaccaucauggaccugcaccccggggccggcaagaccaagcgcuaccuccccgccaucgugcgggaggccaucaagcgcgggcugcggacccugauccucgcgccgacgcgcgucguggccgccgagauggaggaggcccugcggggccugcccauccgcuaccagacccccgccauccgggcggagcacaccgggcgcgagaucguggaccucaugugccacgccaccuucacgaugcgccugcugucccccguccgggugccgaacuacaaccucaucaucauggacgaggcccacuucaccgaccccgccagcaucgccgcgcgcggcuacaucagcacccggguggagaugggcgaggccgccgggaucuucaugaccgccacgccgcccggcucccgcgacccguucccccagagcaacgcccccaucaucgacgaggagcgggagauccccgagcgcuccuggaacagcgggcacgagugggucaccgacuucaagggcaagaccgugugguucgugccguccaucaaggcggggaacgacaucgccgccugccugcggaagaacggcaagaaggucauccagcugagccgcaagaccuucgacuccgaguacgugaagacgcggaccaacgacugggacuucguggucaccaccgacaucagcgagaugggcgccaacuucaaggcggagcgcgugaucgacccccggcgcugcaugaagcccgugauccucacggacggggaggagcgggucauccuggccggccccaugccggugacccacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaagacccgcgacgcccucgacaaccuggccguccugcacaccgccgaggccggcgggcgggccuacaaccacgcccucagcgagcugcccgagacccuggagacgcuccugcugcucacccugcuggccaccgugaccggcgggaucuuccucuuccugauguccgggcgcgggaucggcaagaugacccuggggaugugcugcaucaucacggccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgacgauggccaacgagaugggcuuccuggagaagaccaagaaggaccucgggcugggcggcaucgccacccagcagccggagagcaacauccuggacaucgaccuccgccccgccuccgccuggacccuguacgcgguggccacgaccuucgugacccccaugcugcggcacagcaucgagaacagcuccgucaacgugagccucaccgccaucgccaaccaggccacggugcugauggggcugggcaagggguggccccucuccaagauggacaucggcgucccgcugcuggcgaucgggugcuacagccaggugaaccccaucacccucaccgccgcccugcugcuccugguggcccacuacgcgaucaucggccccggccugcaggccaaggccacccgcgaggcccagaagcgggccgcggccgggaucaugaagaaccccacggucgacggcaucaccgugaucgaccucgacccgauccccuacgaccccaaguucgagaagcagcugggccaggugaugcugcucguccugugcgugacccaggugcugaugaugcgcaccacgugggcccucugcgaggcccugacccuggccaccggccccaucuccacccucugggaggggaacccgggccgguucuggaacacgaccaucgcggucagcauggccaacaucuuccgcggcuccuaccuggccggggccggccuccucuucagcaucaugaagaacaccaccaacacgcggcgcgggaccggcaacaucggcgagacccugggggagaaguggaagucccgccugaacgcccucggcaagagcgaguuccagaucuacaagaaguccgggauccaggagguggaccggacccuggcgaaggagggcaucaagcgcggggagacggaccaccacgccgugagccggggcuccgccaagcugcgcugguucgucgagcggaacauggugacccccgagggcaagguggucgaccucgggugcggccgcgggggcuggagcuacuacugcgggggccugaagaacgugcgggaggugaagggccugaccaagggcgggcccgggcacgaggagcccaucccgauguccaccuacggcuggaaccucguccgccugcagagcgggguggacguguucuucaucccgcccgagaagugcgacacgcugcucugcgacaucggcgaguccagccccaacccgaccgucgaggccggccggacccugcgcgugcugaaccucguggagaacuggcugaacaacaacacccaguucugcaucaagguccugaaccccuacaugcccuccgugaucgagaagauggaggcgcugcagcggaaguacgggggcgcccucgugcgcaacccgcugagccggaacagcacccacgagauguacugggucuccaacgccagcgggaacaucguguccagcgugaacaugaucucccgcaugcugaucaaccgguucacgaugcgccacaagaaggccaccuacgagcccgacgucgaccucggcagcgggacccggaacaucggcaucgaguccgaggugcccaaccuggacaucaucggcaagcgcaucgagaagaucaagcaggagcacgagaccagcuggcacuacgaccaggaccaccccuacaagacgugggccuaccacggguccuacgagaccaagcagaccggcagcgcguccagcauggugaacggggucgugcggcugcucaccaagccgugggacgugcugcccacggucacccagauggccaugaccgacaccacgcccuucggccagcagcgcguguucaaggagaagguggacacccgcacccaggagcccaaggagggcaccaagaagcugaugaagaucacggccgaguggcucuggaaggagcuggggaagaagaagaccccgcggaugugcacccgcgaggaguucacccggaagguccgcuccaacgccgcccugggcgcgaucuucacggacgagaacaaguggaaguccgcccgggaggccguggaggacucccgcuucugggagcucgucgacaaggagcggaaccugcaccuggaggggaagugcgagaccugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccgggguggagggcgaggggcuccacaagcugggcuacauccugcgcgacgucagcaagaaggagggcgggaccauguacgccgacgacaccgccggcugggacacgcggaucacccucgaggaccugaagaacgaggagauggugaccaaccacauggagggggagcacaagaagcuggcggaggccaucuucaagcucaccuaccagaacaaggugguccgcgugcagcggcccacgccccgcggcaccgugauggacaucaucagccggcgcgaccagcggggguccggccaggucggcaccuacgggcugaacaccuucacgaacauggaggcccagcugauccgccagauggagggcgaggggguguucaagaacauccagcaccucaccgugaccgaggagaucgccguccagaacuggcuggcccgggugggccgcgagcgccugagccggauggcgaucuccggcgacgacugcguggucaagccccucgacgaccgcuucgccagcgcccugaccgcccugaacgacauggggaagauccggaaggacauccagcagugggagccgucccgcggcuggaacgacuggacccaggugcccuucugcagccaccacuuccacgagcucaucaugaaggacgggcgggugcuggucgugcccugccgcaaccaggacgagcugaucggccgggcccgcaucucccagggggcgggcuggagccuccgggagaccgccugccugggcaaguccuacgcccagauguggagccugauguacuuccaccgccgggaccuccgccuggccgccaacgcgaucugcuccgccgugcccagccacugggucccgaccucccggaccaccuggagcauccacgccaagcacgaguggaugacgaccgaggacaugcugaccguguggaaccgcguguggauccaggagaaccccuggauggaggacaagacccccgucgacuccugggaggagauccccuaccucgggaagcgggaggaccaguggugcggcagccugaucgggcugacgucccgcgccaccugggccaagaacauccaggcggccaucaaccaggugcggagccucaucggcaacgaggaguacaccgacuacaugccgagcaugaagcgcuuccggcgcgaggaggaggaggccggggugcugugguga

SEQ ID NO: 9351 - RNA, 9876 nt, Artificial Sequence
  derived and/or modified CDS sequence (opt1) from DENV-2__GQ868544__SS-prME
agcgugggcaugaucaucaugcugauccccaccgucauggccuuccaccucaccacccggaacggggagccccacaugaucgugagcauccaggagaagggcaagagccugcuguucaagaccgaggacggggugaacaugugcacccucauggccauggaccugggcgagcugugcgaggacaccaucaccuacaagugcccccuccugcggcagaacgagcccgaggacaucgacugcuggugcaacagcaccagcaccugggucaccuacgggacgugcaccaccaccggcgagcaccgccgggagaagcgcuccguggcgcuggugccccacgucggcauggggcucgagacgcggaccgagaccuggaugagcuccgagggcgccuggaagcacgcccagcgcaucgagaccuggauccugcggcacccgggguucacgaucauggccgccauccuggcguacaccaucggcaccacccacuuccagcgcgcccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagcacgcgguggggaacgacacgggcaagcacgggaaggagaucaaggugaccccgcaguccagcaucaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacccuggucacguucaagaacccccacgccaagaagcaggacguggucgugcucggcagccaggagggggcgaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggucaaggagaucgccgagacccagcacggcaccaucgugauccgggugcaguacgagggggacggcucccccugcaagguccccuucgagaucauggaccuggagaagcgcuacgugcucggccggcugaucacggugaacccgaucgucaccgagaaggacagccccgugaacaucgaggccgagccgcccuucggggacuccuacaucaucaucggcguggagccggggcagcugaagcucaacugguucaagaagggcagcuccaucgggcagauguucgagaccaccaugcgcggcgcgaagcgcauggccauccugggcgacacggccugggacuucgggagccugggcggggucuucaccuccaucggcaaggcccuccaccagguguucggggccaucuacggcgcggccuucagcggcguguccuggaccaugaagauccugaucggggucaucaucaccuggaucggcaugaacagccgguccacgagccuguccgugagccuggugcucgucgggaucgugacccuguaccugggcgugaugguccaggccgacuccgggugcguggugagcuggaagaacaaggagcucaagugcggcagcggcaucuucaucaccgacaacguccacaccuggacggagcaguacaaguuccagcccgagucccccagcaagcuggccuccgcgauccagaaggcccaggaggaggggaucugcggcauccgcagcgugacccggcuggagaaccucauguggaagcagaucacccccgagcugaaccacauccuggccgagaacgaggugaagcucaccaucaugacgggggacaucaagggcaucaugcaggccgggaagcgcucccugcggccgcagcccaccgagcugaaguacagcuggaagaccuggggcaaggccaagaugcucuccaccgagagccacaaccagacguuccugaucgacggccccgagaccgcggagugcccgaacaccaaccgcgccuggaacucccuggaggucgaggacuacggguucggcguguucaccacgaacaucuggcucaagcugaaggagaagcaggacgccuucugcgacagcaagcugauguccgccgccaucaaggacaaccgggcggugcacgccgacaugggguacuggaucgagagcgcccucaacgacaccuggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgcgggccccuggcaccuggggaagcuggagauggacuucgacuucugcgacggcaccacggucguggugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggucaacagccucgugaccgccggccaggggcagaucgacaacuucucccugggcgugcugggcauggcccucuuccuggaggagaugcugcggacgcgcgucgggaccaagcacgcgauccuccugguggccgugagcuucgucacccugaucaccggcaacauguccuucaaggaccucgggcgggugguggucauggugggcgccacgaugaccgacgacaucgggaugggcgugaccuaccuggcccugcucgccgcguucaagguccgccccaccuucgccgccggccugcugcuccggaagcugacgagcaaggagcugaugaugaccaccaucgggaucgugcuccugucccagagcaccauccccgagacgauccuggagcucaccgacgcccuggcccugggcaugauggugcucaagaucguccgcgacauggagaaguaccagcuggcggugaccaucauggccauccugugcgucccgaacgccgugauccuccagaacgccuggaagguguccugcaccauccuggccgucgugagcgugagcccccugcuccugacgagcucccagcagaagaccgacuggaucccccuggcgcucaccaucaaggggcugaaccccaccgccaucuuccugacgacccucagccgcaccaacaagaagcgguccuggccgcugaacgaggccaucauggccgucggcauggugagcauccuggcguccagccuccugaagaacgacauccccaugaccggcccccugguggccgggggccuccugacggucugcuacgugcugaccgggcgcuccgccgaccucgagcuggagcgggccaccgacgugaagugggaggaccaggccgagaucagcggcagcucccccauccugagcaucaccaucuccgaggacgggagcauguccaucaagaacgaggaggaggagcagacgcucaccauccugauccgcaccggccugcucgucaucagcggccuguucccgguguccauccccaucaccgcggccgccugguaccugugggaggugaagaagcagcgggccgggguccucugggacgugcccuccccgccgcccaugggcaaggccgagcuggaggacggggcguaccgcaucaagcagaagggcauccugggguacucccagaucggcgccggcguguacaaggaggggaccuuccacacgauguggcacgucacccggggcgccgugcucaugcacaaggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagaccaagcccgggcuguucaagaccaacacgggcaccaucggggccgucagccucgacuucucccccggcaccagcggcucccccaucaucgacaagaaggggaagguggugggccuguacgggaacggcgucgugacccgcagcggcgccuacguguccgccaucgcccagacggagaaguccaucgaggacaaccccgacaucgaggacgacaucuuccggaagcgccggcugaccaucauggaccugcaccccggggcgggcaagaccaagcgcuaccuccccgccaucguccgggaggccaucaagcgcgggcugcggacccugauccucgccccgacgcgcgugguggcggccgagauggaggaggcccugcggggccugcccauccgcuaccagacccccgccauccgggccgagcacaccgggcgcgagaucgucgaccucaugugccacgcgaccuucacgaugcgccugcugucccccgugcgggugccgaacuacaaccucaucaucauggacgaggcccacuucaccgaccccgccagcaucgccgcccgcggcuacaucagcacccgggucgagaugggcgaggcggccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagaccuucgacuccgaguacgugaagacgcggaccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccgugcugcacaccgccgaggccgggggccgggcguacaaccacgcccucagcgagcugcccgagacccuggagacgcuccugcugcucacccugcuggccaccgugaccgggggcaucuuccucuuccugauguccggccgcgggaucggcaagaugacccuggggaugugcugcaucgucacggccagcauccuccugugguacgcccagauccagccgcacuggaucgcggccuccaucauccuggaguucuuccucaucgugcugcugauccccgagcccgagaagcagcggacgccccaggacaaccagcucaccuacguggucaucgccauccugaccgugguggccgccacgauggcgaacgagaugggcuuccuggagaagaccaagaaggaccucgggcugggcagcaucgccacccagcagccggaguccaacauccuggacaucgaccuccgccccgccagcgccuggacccuguacgccgucgcgacgaccuucgugacccccaugcugcggcacagcaucgagaacuccagcgugaacgucucccucaccgccaucgccaaccaggccacggugcugaugggccuggggaagggcuggccccucagcaagauggacaucggggugccgcugcuggccaucggcugcuacucccaggucaaccccaucacccucaccgcggcccugcugcuccugguggcccacuacgccaucaucgggcccggccugcaggcgaaggccacccgcgaggcccagaagcgggccgccgcgggcaucaugaagaaccccacgguggacgggaucaccgucaucgaccucgacccgauccccuacgaccccaaguucgagaagcagcugggccaggugaugcugcucgugcugugcgucacccaggugcugaugaugcgcaccacgugggcccucugcgaggcccugacccuggccaccgggcccaucagcacccucugggagggcaacccggggcgguucuggaacacgaccaucgccguguccauggcgaacaucuuccgcggcagcuaccuggccggcgccgggcuccuguucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgcggugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacgcugcucugcgacaucggggagagcucccccaacccgaccguggaggccggccggacccugcgcguccugaaccucguggagaacuggcugaacaacaacacccaguucugcaucaaggugcugaaccccuacaugcccagcgucaucgagaagauggagacccugcagcggaaguacggcggggcccucgugcgcaacccgcugagccggaacuccacgcacgagauguacugggugagcaacgcguccggcaacaucgucagcuccgugaacaugaucagccgcaugcugaucaaccgguucaccaugcgccacaagaaggccaccuacgagcccgacguggaccucggguccggcacccggaacaucgggaucgagagcgagauccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggucaacggcguggugcggcugcucacgaagccgugggacguccugcccaccgugacccagauggccaugaccgacacgacccccuucgggcagcagcgcguguucaaggagaaggucgacacccgcacccaggagcccaaggagggcacgaagaagcugaugaagaucaccgcggaguggcucuggaaggagcugggcaagaagaagaccccgcggaugugcacccgcgaggaguucacgcggaaggugcgcagcaacgccgcccugggggccaucuucaccgacgagaacaaguggaaguccgcccgggaggcggucgaggacagccgcuucugggagcucguggacaaggagcggaaccugcaccuggagggcaagugcgagaccugcguguacaacaugauggggaagcgcgagaagaagcucggcgaguucgggaaggccaagggcucccgggccaucugguacauguggcugggcgcccgcuuccuggaguucgaggcccucggguuccugaacgaggaccacugguucagccgggagaacucccugagcggcgucgagggggagggccucuacaagcugggguacauccugcgcgacgugagcaagaaggagggcggcgcgauguacgccgacgacaccgccgggugggacacgcggaucacccucgaggaccugaagaacgaggagauggugaccaaccacauggagggcgagcacaagaagcuggccgaggcgaucuucaagcucaccuaccagaacaaggucgugcgcgugcagcggcccacgccccgcgggaccgucauggacaucaucucccggcgcgaccagcggggcagcggccagguggggaccuacggccugaacaccuucacgaacauggaggcccagcugauccgccagauggagggggagggcguguucaagaacauccagcaccucaccgucaccgaggagaucgccgugcagaacuggcuggcccggguggggcgcgagcgccugucccggauggccaucagcggcgacgacugcgucgugaagccccucgacgaccgcuucgcguccgcccugaccgcccugaacgacaugggcaagauccggaaggacauccagcagugggagccgagccgcggguggaacgacuggacccaggugcccuucugcucccaccacuuccacgagcucaucaugaaggacggccggguccugguggugcccugccgcaaccaggacgagcugaucgggcgggcccgcaucagccagggcgccggguggucccuccgggagaccgcgugccugggcaagagcuacgcccagauguggucccugauguacuuccaccgccgggaccuccgccuggccgccaacgccaucugcagcgcgguccccucccacugggugccgaccagccggaccaccugguccauccacgccaagcacgaguggaugacgaccgaggacaugcugaccguguggaaccgcgucuggauccaggagaaccccuggauggaggacaagacccccguggagagcugggaggagauccccuaccucggcaagcgggaggaccaguggugcgggucccugaucggccugacgagccgcgccaccugggccaagaacauccaggccgcgaucaaccaggugcggagccucaucgggaacgaggaguacaccgacuacaugccguccaugaagcgcuuccggcgcgaggaggaggaggccggcguccugugguga

SEQ ID NO: 9352 - RNA, 9876 nt, Artificial Sequence
  derived and/or modified CDS sequence (opt1) from DENV-2__GQ868545__SS-prME
agcgcgggcaugaucaucaugcugauccccaccgugauggcguuccaccucaccacccgcaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucaccaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgucugcaagcacuccaucguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcgugaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacacccaggggagcaacuggauccagaaggagacccuggucacguucaagaacccccacgcgaagaagcaggacguggucgugcucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggucaaggagaucgccgagacccagcacggcaccaucgugauccgggugcaguacgagggggacggcucccccugcaagauccccuucgagaucauggaccuggagaagcgcuacguccucggccggcugaucacggugaacccgaucgugaccgagaaggacagccccgucaacaucgaggcggagccgcccuucggggacuccuacaucaucaucggcguggagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccaggucuucggggcgaucuacggcgccgccuucagcggcguguccuggaccaugaagauccugaucggggugaucaucaccuggaucggcaugaacagccgguccacgagccuguccgucagccuggugcucguggggaucgucacccuguaccugggcgugauggugcaggccgacuccgggugcgucgugagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgucacccggcuggagaaccucauguggaagcagaucacccccgagcugaaccacauccuggccgagaacgaggugaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccgagaccgccgagugcccgaacaccaaccgcgccuggaacucccuggagguggaggacuacggguucggcgucuucaccacgaacaucuggcucaagcugaaggagaagcaggacgccuucugcgacagcaagcugauguccgccgcgaucaaggacaaccgggccgugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgcgggccccgugucccagcacaacuaccgcccgggguaccacacccagaucgccggccccuggcaccuggggaagcuggagauggacuucgacuucugcgacggcaccacgguggucgugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucaccgccggccacgggcagaucgacaacuucucccugggcgugcugggcauggcccucuuccuggaggagaugcugcggacgcgcguggggaccaagcacgccauccuccuggucgccgugagcuucgugacccugaucaccggcaacauguccuucaaggaccucgggcgggucguggugauggucggcgccacgaugaccgacgacaucgggaugggcgugaccuaccuggcccugcucgcggccuucaaggugcgccccacccuggccgccggccugcuccugcggaagcugacgagcaaggagcucaugaugaccaccaucgggaucguccugcugucccagagcaccauccccgagacgauccucgagcugaccgacgcccuggcgcucggcaugauggugcugaagaucgugcgcgacauggagaaguaccagcuggccgucaccaucauggccacccucugcgugccgaacgccgucauccugcagaacgccuggaagguguccugcacgauccuggcgguggucagcgugagcccccuccugcugaccagcucccagcagaagaccgacuggaucccccucgcccugaccaucaaggggcugaaccccacggccaucuuccucaccacccugagccgcaccaacaagaagcgguccuggccgcugaacgaggccaucauggcggugggcauggucagcauccucgccuccagccugcugaagaacgacauccccaugacgggcccccucguggccgggggccugcugaccgugugcuacguccucaccgggcgcuccgccgaccuggagcuggagcgggccaccgacgugaagugggaggaccaggcggagaucagcggcagcucccccauccucagcaucacgaucuccgaggacgggagcauguccaucaagaacgaggaggaggagcagacccugaccauccugauccgcaccggccuccuggugaucagcggccuguucccggucuccauccccaucaccgccgccgccugguaccucugggaggugaagaagcagcgggccggggugcugugggacguccccuccccgccgcccaugggcaaggcggagcuggaggacggggccuaccgcaucaagcagaagggcauccucggguacucccagaucggcgccggcguguacaaggaggggacguuccacaccauguggcacgugacccggggcgccguccugaugcacaaggggaagcgcaucgagcccagcugggccgacgugaagaaggaccugaucuccuacggcgggggcuggaagcucgagggcgaguggaaggagggggaggaggugcagguccuggcgcuggagcccggcaagaacccccgggccgugcagaccaagcccggccucuucaagacgaacaccggcaccaucggggccgugagccuggacuucucccccggcaccagcggcucccccaucaucgacaagaaggggaaggucgugggccuguacgggaacggcguggucacgcgcagcggcgccuacguguccgccaucgcgcagaccgagaaguccaucgaggacaaccccgacaucgaggacgacaucuuccggaagcgccggcugaccaucauggaccuccaccccggggccggcaagaccaagcgcuaccugcccgccaucgugcgggaggccaucaagcgcgggcugcggacgcucauccuggcgccgacccgcgucguggccgccgagauggaggaggcccugcggggccuccccauccgcuaccagacccccgccauccgggcggagcacaccgggcgcgagaucguggaccugaugugccacgccacguucaccaugcgccugcucucccccguccgggugccgaacuacaaccugaucaucauggacgaggcccacuucaccgaccccgccagcaucgccgcgcgcggcuacaucagcacccggguggagaugggcgaggccgccgggaucuucaugacggccacgccgcccggcucccgcgacccguucccccagagcaacgcccccaucaucgacgaggagcgggagauccccgagcgcuccuggaacagcgggcacgagugggucaccgacuucaagggcaagaccgugugguucgugccguccaucaaggcggggaacgacaucgccgccugccugcggaagaacggcaagaaggucauccagcucagccgcaagacguucgacuccgaguacgugaagacccggaccaacgacugggacuucguggucaccacggacaucagcgagaugggcgccaacuucaaggcggagcgcgugaucgacccccggcgcugcaugaagcccgugauccugaccgacggggaggagcgggucauccuggccggccccaugccggugacccacuccagcgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccguccauguucgagcccgagcgcgagaagguggacgccaucgacggcgaguaccggcuccgcggggaggcccgcaagacguucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacagcgacccccuggcccugaaggaguucaaggaguucgccgcgggccgcaagucccucacccugaaccugaucaccgagaugggccggcuccccacguucaugacccagaagacccgcgacgcccuggacaaccuggccguccuccacaccgccgaggccggcgggcgggccuacaaccacgcccugagcgagcugcccgagacgcucgagacccugcugcuccugacccugcucgccaccgugaccggcgggaucuuccuguuccugauguccgggcgcgggaucggcaagaugacgcucgggaugugcugcaucaucaccgccagcauccugcugugguacgcgcagauccagccgcacuggaucgccgccuccaucauccucgaguucuuccugaucgugcugcucauccccgagcccgagaagcagcggacgccccaggacaaccagcugaccuacgucgugaucgccauccugacgguggucgccgcgaccauggccaacgagaugggcuuccucgagaagaccaagaaggaccuggggcugggcagcaucgccacccagcagccggaguccaacauccucgacaucgaccugcgccccgccagcgccuggacgcuguacgcgguggccaccaccuucgugacccccaugcuccggcacagcaucgagaacuccagcgucaacgugucccugacggccaucgccaaccaggccaccgugcugaugggccucgggaagggcuggccccugagcaagauggacaucggggucccgcugcucgcgaucggcugcuacucccaggugaaccccaucacccugaccgccgcccugcuccugcugguggcccacuacgcgaucaucgggcccggccuccaggccaaggccacgcgcgaggcccagaagcgggccgcggccggcaucaugaagaaccccaccgucgacgggaucaccgugaucgaccuggacccgauccccuacgaccccaaguucgagaagcagcugggccaggugaugcuccugguccugugcgugacccaggugcucaugaugcgcacgaccugggcccugugcgaggcccugacccucgccaccgggcccaucagcacgcugugggagggcaacccggggcgguucuggaacaccaccaucgcggucuccauggccaacaucuuccgcggcagcuaccuggccggcgccgggcuccuguucuccaucaugaagaacaccacgaacacccggcgcggcaccgggaacaucggcgagacccugggcgagaaguggaagucccgccucaacgcccuggggaaguccgaguuccagaucuacaagaaguccggcauccaggagguggaccggacgcuggcgaaggaggggaucaagcgcggcgagaccgaccaccacgccgugucccgggggagcgccaagcuccgcugguucgucgagcggaacauggugacccccgagggcaagguggucgaccugggcugcgggcgcggcgggugguccuacuacugcggcgggcugaagaacgugcgggaggugaagggccucaccaagggcgggcccggccacgaggagcccaucccgaugagcacguacggguggaaccugguccgccugcaguccggcguggacguguucuucaucccgcccgagaagugcgacacccuccugugcgacaucggggagagcucccccaacccgaccgucgaggccggccggacccugcgcgugcucaaccugguggagaacuggcugaacaacaacacccaguucugcaucaagguccugaaccccuacaugcccagcgugaucgagaagauggagacgcuccagcggaaguacggcggggcgcuggugcgcaacccgcugagccggaacuccacccacgagauguacugggucagcaacgccuccggcaacaucgugagcuccgugaacaugaucagccgcaugcucaucaaccgguucaccaugcgccacaagaaggccaccuacgagcccgacgucgaccugggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcuccugaccaagccgugggacgugcugcccaccgugacccagauggcgaugacggacaccacccccuucgggcagcagcgcgucuucaaggagaagguggacacccgcacgcaggagcccaaggagggcaccaagaagcucaugaagaucaccgccgaguggcuguggaaggagcugggcaagaagaagaccccgcggaugugcacgcgcgaggaguucacccggaaggugcgcagcaacgccgcccucggggccaucuucaccgacgagaacaaguggaaguccgcgcgggaggccgucgaggacagccgcuucugggagcugguggacaaggagcggaagcugcaccucgagggcaagugcgagaccugcgucuacaacaugauggggaagcgcgagaagaagcugggcgaguucgggaaggccaagggcucccgggccaucugguacauguggcugggcgcccgcuuccucgaguucgaggcgcugggguuccugaacgaggaccacugguucagccgggagaacucccucagcggcguggagggggagggccugcacaagcugggguacauccuccgcgacgugagcaagaaggagggcggcgccauguacgccgacgacacggccgggugggacacccggaucacccuggaggaccugaagaacgaggagauggucaccaaccacauggagggcgagcacaagaagcucgcggaggccaucuucaagcugacguaccagaacaagguggugcgcguccagcggcccacgccccgggggaccgugauggacaucaucucccggcgcgaccagcggggcagcggccagguggggaccuacggccugaacacguucaccaacauggaggcccagcucauccgccagauggagggggagggcgucuucaagaacauccagcaccugaccgugaccgaggagaucgccgugcagaacuggcuggcccgggucgggcgcgagcgccucucccggauggcgaucagcggcgacgacugcguggugaagccccuggacgaccgcuucgccuccgcccugacggcccucaacgacaugggcaagauccggaaggacauccagcagugggagccgagccgcggguggaacgacuggacccagguccccuucugcucccaccacuuccacgagcugaucaugaaggacggccgggugcuggugguccccugccgcaaccaggacgagcucaucgggcgggcccgcaucagccagggcgcgggguggucccugcgggagaccgccugccugggcaagagcuacgcccagauguggucccucauguacuuccaccgccgggaccugcgccuggccgccaacgcgaucugcagcgccgugcccucccacugggugccgaccagccggaccacgugguccauccacgccaagcacgaguggaugaccaccgaggacaugcucaccgucuggaaccgcguguggauccaggagaaccccuggauggaggacaagacgcccguggagagcugggaggagauccccuaccugggcaagcgggaggaccaguggugcgggucccugaucggccucaccagccgcgccaccugggccaagaacauccaggcggccaucaaccagguccggagccugaucgggaacgaggaguacaccgacuacaugccguccaugaagcgcuuccggcgcgaggaggaggaggccggcgugcugugguga

SEQ ID NO: 9353 - RNA, 9876 nt, Artificial Sequence
  derived and/or modified CDS sequence (opt1) from DENV-2__GQ868543__SS-prME
agcgccggcaugaucaucaugcugauccccaccgugauggccuuccaccucaccacccgcaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcgcauggccauccugggggacaccgccugggacuucggcucccucggcgggauguucacgagcaucgggaaggcccuccaccagguguucggcgcgaucuacggcgccgccuucuccggggugagcuggaccaugaagauccugaucggcgucaucaucaccuggaucgggaugaacucccggagcaccucccugagcgugucccuggugcucgucggcaucgugacgcuguaccugggggugaugguccaggccgacagcggcugcgugguguccuggaagaacaaggagcucaagugcggcagcgggaucuucaucaccgacaacguccacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggaggucgaggacuacggcuucgggguguucaccaccaacaucuggcucaagcugaaggagaagcaggacgccuucugcgacuccaagcugaugagcgccgcgaucaaggacaaccgggccgugcacgccgacaugggcuacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgcggggcccgugagccagcacaacuaccgcccgggcuaccacacccagaucgccgggcccuggcaccugggcaagcuggagauggacuucgacuucugcgacgggaccaccgucguggugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggauggcccuguuccuggaggagaugcugcggacccgcgugggcacgaagcacgccauccuccugguggccgucuccuucgugacccugaucaccgggaacaugagcuucaaggaccucggccggguggucgugauggugggggccaccaugacggacgacaucggcaugggcgucaccuaccuggcccugcucgcggccuucaaggugcgccccaccuucgccgccgggcugcugcuccggaagcugaccuccaaggagcugaugaugacgaccaucggcaucgugcuccugagccaguccaccauccccgagaccauccuggagcucacggacgcccuggcgcuggggaugaugguccucaagaucgugcgcaacauggagaaguaccagcuggccgugaccaucauggccauccugugcgucccgaacgccgugauccuccagaacgccuggaaggucagcugcaccauccuggcggugguguccgucagcccccugcuccugaccuccagccagcagaagacggacuggaucccccuggcccucaccaucaagggccugaaccccaccgccaucuuccugaccacgcucucccgcaccaacaagaagcggagcuggccgcugaacgaggccaucauggcggugggcaugguguccauccuggccagcucccuccugaagaacgacauccccaugaccgggccccuggucgccggcgggcuccugaccgugugcuacgugcugacgggccgcagcgccgaccucgagcuggagcgggccaccgacgucaagugggaggaccaggcggagaucuccgggagcagccccauccuguccaucaccaucagcgaggacggcuccaugagcaucaagaacgaggaggaggagcagacccucacgauccugauccgcaccggccugcucgugaucuccgggcuguucccggugagcauccccaucaccgccgccgccugguaccugugggaggucaagaagcagcgggccggcgugcucugggacgugcccagcccgccgcccauggggaaggcggagcuggaggacggcgccuaccgcaucaagcagaaggggauccugggcuacagccagaucggcgccggggucuacaaggagggcaccuuccacaccauguggcacgugacgcgcggggcggugcucaugcacaagggcaagcgcaucgagcccuccugggccgacgucaagaaggaccugaucagcuacgggggcggcuggaagcuggagggggaguggaaggagggcgaggagguccaggugcucgcgcuggagcccgggaagaacccccgggccguccagaccaagcccggccuguucaagaccaacaccgggacgaucggcgccgugucccucgacuucagccccggcaccuccgggagccccaucaucgacaagaagggcaagguggucgggcuguacggcaacggcguggugacccgcuccggggccuacgucagcgccaucgcgcagaccgagaaguccaucgaggacaaccccgagaucgaggacgacaucuuccggaagcgccggcugacgaucauggaccugcaccccggcgccgggaagaccaagcgcuaccuccccgccaucgugcgggaggccaucaagcgcggccugcggacccugauccucgcgccgacccgcguggucgccgccgagauggaggaggcccugcgggggcugcccauccgcuaccagacgcccgccauccgggcggagcacaccggccgcgagaucguggaccucaugugccacgccaccuucaccaugcgccugcugagccccgugcgggucccgaacuacaaccucaucaucauggacgaggcccacuucacggaccccgccuccaucgccgcgcgcggcuacaucagcacccggguggagaugggggaggccgccggcaucuucaugaccgccacgccgcccgggagccgcgacccguucccccaguccaacgcccccaucaucgacgaggagcgggagauccccgagcgcagcuggaacuccggccacgagugggugacggacuucaaggggaagaccgucugguucgugccgagcaucaaggcgggcaacgacaucgccgccugccugcggaagaacggcaagaaggugauccagcugucccgcaagaccuucgacagcgaguacgucaagacccggacgaacgacugggacuucguggugaccaccgacaucuccgagaugggggccaacuucaaggcggagcgcgucaucgacccccggcgcugcaugaagcccgugauccucaccgacggcgaggagcgggugauccuggccgggcccaugccggucacgcacagcuccgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgcgagaagguggacgccaucgacggggaguaccggcugcgcggcgaggcccgcaagaccuucguggaccucaugcggcgcggggaccugcccgucuggcuggccuacaagguggccgcggagggcaucaacuacgccgaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgcgggccgcaagagccugacgcucaaccugaucaccgagauggggcggcugcccaccuucaugacccagaagacgcgcgacgcccucgacaaccuggccgugcugcacaccgccgaggcgggcgggcgggccuacaaccacgcccucuccgagcugcccgagacccuggagacccuccugcugcucacgcugcuggccaccgucaccggcggcaucuuccucuuccugaugagcgggcgcggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgaccauggccaacgagaugggguuccuggagaagacgaagaaggaccucggccugggcuccaucgccacccagcagccggagagcaacauccuggacaucgaccuccgccccgccuccgccuggacccuguacgcggucgccaccacguucgugacccccaugcugcggcacagcaucgagaacagcuccgugaacgucagccucaccgccaucgccaaccaggccaccgugcugauggggcugggcaagggguggccccucuccaagauggacaucggcgugccgcugcuggcgaucgggugcuacagccaggucaaccccaucacgcucaccgccgcccugcugcuccugguggcccacuacgcgaucaucggccccggccugcaggccaaggccacccgcgaggcccagaagcgggccgcggccgggaucaugaagaaccccaccguggacggcaucacggucaucgaccucgacccgauccccuacgaccccaaguucgagaagcagcugggccaggugaugcugcucauccugugcgugacccagguccugaugaugcgcaccaccugggcccucugcgaggcccugacgcuggugaccggccccaucuccacccucugggaggggaacccgggccgguucuggaacaccacgaucgccgugagcauggcgaacaucuuccgcggcuccuaccuggccggggccggccuccucuucagcaucaugaagaacaccaccaacacccggcgcgggacgggcaacaucggcgagacccugggggagaaguggaagucccgccugaacgcccucggcaagagcgaguuccagaucuacaagaaguccgggauccaggaggucgaccggacccuggccaaggagggcaucaagcgcggggagaccgaccaccacgcggugagccggggcuccgccaagcugcgcugguucguggagcggaacauggucacgcccgagggcaaggugguggaccucgggugcggccgcgggggcuggagcuacuacugcgggggccugaagaacguccgggaggugaagggccugaccaagggcgggcccgggcacgaggagcccaucccgauguccaccuacggcuggaaccucgugcgccugcagagcggggucgacguguucuucaucccgcccgagaagugcgacacccugcucugcgacaucggcgaguccagccccaacccgacgguggaggccggccggacccugcgcguccugaaccucguggagaacuggcugaacaacaacacccaguucugcaucaaggugcugaaccccuacaugcccuccgucaucgagaagauggaggcccugcagcggaaguacgggggcgcgcucgugcgcaacccgcugagccggaacagcacccacgagauguacuggguguccaacgccagcgggaacaucgucuccagcgugaacaugaucucccgcaugcugaucaaccgguucaccaugcgccacaagaaggccacguacgagcccgacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggucaacgggguggugcggcugcucaccaagccgugggacguccugcccaccgugacgcagauggcgaugaccgacaccacccccuucggccagcagcgcguguucaaggagaaggucgacacgcgcacccaggagcccaaggagggcaccaagaagcugaugaagaucaccgccgaguggcucuggaaggagcuggggaagaagaagacgccgcggaugugcacccgcgaggaguucacccggaaggugcgcuccaacgccgcccugggcgccaucuucaccgacgagaacaaguggaaguccgcgcgggaggccguggaggacucccgcuucugggagcucgucgacaaggagcggaaccugcaccuggaggggaagugcgagacgugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccggggucgagggcgaggggcuccacaagcugggcuacauccugcgcgacgugagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggucgugcgcgugcagcggcccacgccccggggcaccgucauggacaucaucagccggcgcgaccagcggggguccggccaggugggcacguacgggcugaacaccuucaccaacauggaggcccagcugauccgccagauggagggcgaggggguguucaagaacauccagcaccucaccgucacggaggagguggccgugcagaacuggcuggcccgggucggccgcgagcgccugagccggauggcgaucuccggcgacgacugcguggugaagccccucgacgaccgcuucgccaacgcccugaccgcccugaacgacauggggaagauccggaaggacauccagcagugggagccgagcaagggcuggaacgacuggacccagguccccuucugcucccaccacuuccacgagcucaucaugaaggacgggcgcgugcuggugguccccugccggaaccaggacgagcugaucggccgcgcccggaucagccagggggcgggcuggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccaggagaaccccuggauggaggacaagacccccguggagagcugggaggagauccccuaccucgggaagcgcgaggaccaguggugcggcucccugaucgggcugaccagccgggccaccugggccaagaacauccaggcggccaucaaccagguccgcucccucaucggcaacgaggaguacacggacuacaugccgagcaugaagcgguuccgccgggaggaggaggaggccggggugcugugguga

SEQ ID NO: 9354 - RNA, 9876 nt, Artificial Sequence
  derived and/or modified CDS sequence (opt1) from DENV-2__EU482544__SS-prME
accgccggcgugaucaucaugcugauccccaccgucauggccuuccaccucaccacccggaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcagcgagggggccuggaagcacgugcagcggaucgagacguggauccugcgccacccgggcuucaccaucauggccgccauccuggcguacaccaucgggaccacgcacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacaccaucgucaucacgccccacagcggggaggagcacgcggugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgccaagaagcaggacgucgugguccuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccacgaugcgcggcgcgaagcggauggccauccugggggacaccgccugggacuucggcagccucgggggcgucuucaccuccaucgggaaggcccugcaccagguguucggcgccaucuacggcgcggccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacaccggcugcguggucuccuggaagaacaaggagcugaagugcggcagcgggaucuucaucacggacaacgugcacaccuggaccgagcaguacaaguuccagcccgagucccccagcaagcuggccagcgcgauccagaaggcccacgaggagggcaucugcgggauccgguccgugacccgccucgagaaccugauguggaagcagaucacgcccgagcugaaccacauccucagcgagaacgaggucaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgccgagugcccgaacacgaaccgggcguggaacucccucgagguggaggacuacggcuucgggguguucagcaccaacaucuggcugaagcugcgcgagaagcaggacgucuucugcgacuccaagcucaugagcgccgccaucaaggacaaccgggccgugcacgccgacaugggcuacuggaucgaguccgcgcugaacgacaccuggaagauggagaaggccagcuucaucgagaucaaguccugccacuggcccaagagccacacccugugguccaacggcgugcucgagagcgagaugaucauccccaagaacuucgccgggcccgucucccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgcggggcacggccagaucgacaacuucucccugggcguccuggggauggcccucuuccuggaggagaugcugcggacccgcgugggcaccaagcacgccauccuccugguggccgucagcuucgugacgcugaucaccgggaacauguccuuccgggaccucggccgcgugauggucauggugggggcgaccaugaccgacgacaucggcaugggcgugacguaccuggcccugcucgccgccuucaagguccgccccaccuucgccgcggggcugcugcuccggaagcugaccagcaaggagcugaugauggccaccaucggcaucgcccuccugucccagagcacgauccccgagaccauccuggagcucaccgacgcccuggcccuggggaugauggugcucaagaucgugcgcaacauggagaaguaccagcuggcggucaccaucauggccaucuccugcgugccgaacgccgugauccugcagaacgccuggaaggucagcugcacgauccucgccgcgguguccgucagcccccugcugcucaccuccagccagcagaaggccgacuggaucccccuggcccugaccaucaagggccucaaccccaccgccaucuuccugacgacccugucccggaccagcaagaagcgcuccuggccgcucaacgaggcggugauggccgugggcauggucagcauccuggccuccagccugcucaagaacgacauccccaugaccgggccccugguggccggcgggcugcucacggugugcuacguccugaccggccggagcgccgaccuggagcucgagcgcgcggccgacgugaagugggaggaccaggccgagaucuccgggagcucccccauccugagcaucaccaucuccgaggacggcagcauguccaucaagaacgaggaggaggagcacacccugacgauccucauccggaccggccugcuggugaucagcggggucuucccgguguccauccccaucaccgccgccgcgugguaccucugggaggugaagaagcagcgcgccggcguccugugggacgugcccagcccgccgcccguggggaaggccgagcuggaggacggcgccuaccggaucaagcagcgcgggaucuucggcuacucccagaucggcgccggggucuacaaggagggcaccuuccacaccauguggcacgugacgcgcggggcggugcucaugcaccgcggcaagcggaucgagcccagcugggccgacgucaagaaggaccugaucuccuacgggggcggcuggaagcuggagggggaguggaaggagggcgaggagguccaggugcucgcccuggagcccgggaagaacccccgcgccguccagaccaagcccggccuguucaagaccaacaccgggacgaucggcgccgugagccucgacuucucccccggcaccagcgggucccccaucguggaccggaagggcaaggucguggggcuguacggcaacggcguggucacccgcagcggggcguacguguccgccaucgcccagaccgagaaguccaucgaggacaaccccgagaucgaggacgacaucuuccggaagaagcgccugacgaucauggaccuccaccccggcgccgggaagaccaagcgguaccugcccgcgaucgugcgcgaggccaucaagcggggccugcgcacccugauccucgccccgacccgcgucguggccgccgagauggaggaggcgcugcgggggcugcccauccgcuaccagacgcccgccauccgggccgagcacaccggccgcgagaucguggaccucaugugccacgccaccuucaccaugcggcugcugagccccguccgcgugccgaacuacaaccucaucaucauggacgaggcccacuucacggaccccgcguccaucgccgcccggggcuacaucagcacccgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggccggcaacgacaucgccgcgugccugcgcaagaacggcaagaaggucauccagcugagccggaagaccuucgacuccgaguacgugaagacccgcgccaacgacugggacuucguggucacgaccgacaucagcgagaugggggccaacuuccgggccgagcgcgugaucgacccccggcgcugcaugaagcccgugauccucaccgacggcgaggagcgggucauccuggccgggcccaugccggugacccacuccagcgcggcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgccaucgacggggaguaccgccugcggggcgaggcgcgcaagaccuucgucgaccucaugcggcgcggggaccugcccguguggcuggccuaccggguggccgccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcgcgcaucuacagcgacccccucgcccugaaggaguucaaggaguucgccgccggccggaagucccugacccucaaccugaucacggagauggggcgccugcccaccuucaugacccagaaggcgcgggacgcccucgacaaccuggccguccugcacaccgccgaggugggcgggcgcgccuacaaccacgcgcucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgccgcguccaucauccuggaguucuuccucaucguccugcugauccccgagcccgagaagcagcggacgccccaggacaaccagcucaccuacguggugaucgccauccugacggucguggccgccaccauggccaacgagaugggguuccuggagaagaccaagaaggaccucggccugggcagcaucaccacgcaggagagcgaguccaacauccuggacaucgaccuccgcccggcgagcgccuggacccuguacgccguggccaccaccuucgucacgcccaugcugcggcacuccaucgagaacagcuccgugaacgugagccucaccgccaucgcgaaccaggccaccguccugauggggcugggccgcggguggccccucuccaagauggacaucggcgugccccugcuggccaucgggugcuacagccaggugaacccgaucacccucacggccgcgcugcugcuccuggucgcccacuacgccaucaucggccccggccugcaggccaaggccacccgcgaggcgcagaagcggaccgccgccgggaucaugaagaaccccaccguggacggcaucacggugaucgaccucgagcccaucccguacgaccccaaguucgagaagcagcuggggcaggucaugcugcucgugcugugcgugacccagguccugaugaugcgcaccaccugggcccucugcgaggcccugacgcuggcgaccggccccaucuccacccucugggaggggaaccccggccgguucuggaacaccacgaucgccgugagcauggccaacaucuuccgcggcuccuaccuggccggggccggccuccucuucagcaucaugaagaacaccaccaacacccggcgcgggacgggcaacaucggcgagacccugggggagaaguggaagucccggcugaacgcgcucggcaagagcgaguuccagaucuacaagaaguccgggauccaggagguggaccgcacccuggccaaggagggcaucaagcgcggggagaccgaccaccacgccgucagccgcggcuccgccaagcugcggugguucguggagcgcaacauggugacgccggagggcaaggucguggaccucgggugcggccgcggcggguggagcuacuacugcggcgggcugaagaacgugcgcgaggucaaggggcugaccaagggcgggcccgggcacgaggagcccauccccauguccaccuacggcuggaaccucgugcggcugcagagcgggguggacgucuucuucaccccgcccgagaagugcgacacgcugcucugcgacaucggcgagagcucccccaaccccaccaucgaggcgggccgcacccugcgggugcugaaccucguggagaacuggcugaacaacaacacccaguucugcgucaaggugcugaacccguacaugcccagcgugaucgagaagauggagacccuccagcgcaaguacgggggcgcccugguccggaacccccugucccgcaacagcacgcacgagauguacuggguguccaacgccaccgggaacaucgugagcuccgucaacaugaucagccgcaugcugaucaaccgguucaccaugaagcacaagaaggccaccuacgagccggacguggaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagaccaagcagacgggcagcgcguccagcauggugaacggggucgugaagcugcucaccaagcccugggacguggucccgauggugacccagauggccaugaccgacacgacccccuucggccagcagcgcguguucaaggagaaggucgacacccggacccaggagcccaaggagggcacgaagaagcugaugcgcaucaccgccgaguggcuguggaaggagcucgggaagaagaagacgccccggaugugcacccgcgaggaguucacgcggaaggugcgcuccaacgccgcccugggcgcgaucuucaccgacgagaacaaguggaaguccgcccgggaggccgucgaggacucccgcuucugggagcugguggaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcgucgagggggagggccugcacaagcucggcuacauccugcgggacguguccaagaaggagggcggggccauguacgccgacgacaccgcggggugggacacgcgcaucacccuggaggaccucaagaacgaggagauggugaccaaccacaugaagggcgagcacaagaagcuggccgaggccaucuucaagcugaccuaccagaacaaggucgugcgggugcagcgcccgacgccccgcgggaccgucauggacaucaucagccggaaggaccagcgcggcuccggccagguggggaccuacggccucaacaccuucacgaacauggaggcccagcugauccggcagauggagggggagggcaucuucaagagcauccagcgccugaccgugaccgaggagaucgccguccagaacuggcucgcgcgggugggccgcgagcggcugucccgcauggccaucagcggggacgacugcguggucaagccccuggacgaccgguucgccuccgcccucaccgcccugaacgacaugggcaaggugcgcaaggacauccagcagugggagcccagccggggguggaacgacuggacccaggugccguucugcucccaccacuuccacgagcuggucaugaaggacggccgcgugcucgugguccccugccggaaccaggacgagcugaucgggcgcgcgcggaucagccagggcgccggcuggucccugaaggagaccgccugccucggcaagagcuacgcccagauguggacccugauguacuuccaccgccgggaccugcgccucgccgcgaacgccaucugcuccgccgugcccagccacugggugcccaccucccggaccacguggagcauccacgccaagcacgaguggaugaccaccgaggacaugcuggccgucuggaaccgcguguggauccaggagaacccguggauggaggacaagacccccguggaguccugggaggagguccccuaccugggcaagcgcgaggaccaguggugcgggagccucaucggccugacgagccgggcgaccugggccaagaacauccagaccgccaucaaccaggugcgcucccugaucgggaacgaggaguacaccgacuacaugcccagcaugaagcgguuccgcaaggaggaggaggaggccggcgugcucugguga

SEQ ID NO: 9355 - RNA, 9876 nt, Artificial Sequence
  derived and/or modified CDS sequence (opt1) from DENV-2__EU482545__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucaugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucgggggcguguucaccuccguggggaaggcccuccaccaggucuucggcgcgaucuacggcgccgccuucagcgggguguccuggaccaugaagauccugaucggcgugaucaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggcccugaagaucgucaagaacauggagaaguaccagcucgccgugaccaucauggccaucuccugcgugccgaacgcggucauccugcagaacgccuggaaggugagcugcacgauccuggccgccguguccgucagcccccuccugcugaccuccagccagcagaaggcggacuggaucccccucgcccugaccaucaagggccugaaccccaccgccaucuuccucacgacccugucccgcaccagcaagaagcgguccuggccgcugaacgaggccaucauggccgugggcauggucagcauccucgcguccagccugcugaagaacgacauccccaugaccgggccccucguggccggcgggcugcugacggugugcuacguccucaccggccgcagcgccgaccuggagcuggagcgggccgccgacgugaagugggaggaccaggcggagaucuccgggagcucccccauccucagcaucaccaucuccgaggacggcagcauguccauccgcaacgaggaggaggagcagacccugacgauccugauccggaccggccuccuggugaucagcggggucuucccgguguccauccccgugaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacaccauguggcacgugacgcgcggggccguccucaugcaccgcggcaagcggaucgagcccagcugggccgacgugaagaaggaccugguguccuacgggggcggcuggaagcuggagggggaguggaaggagggcgaggagguccaggugcucgcgcuggagcccgggaagaacccccgcgccgugcagaccaagcccggcaucuucaagaccaacaccgggacgaucggcgccgucagccuggacuucucccccggcaccagcgggucccccaucguggaccggaagggcaagguggucgggcucuacggcaacggcguggugacccgcagcggggccuacgucuccgcgaucgcccagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggcgccgacccgcguggucgccgccgagauggaggaggcccuccgggggcugcccauccgcuaccagacgcccgccauccgggcggagcacaccggccgcgagaucguggaccugaugugccacgccaccuucaccaugcggcuccugagccccgugcgcgucccgaacuacaaccugaucaucauggacgaggcccacuucacggaccccgccuccaucgccgcgcggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugacggacuucaaggggaagaccgucugguucgugccguccaucaaggccggcaacgacaucgccgccugccuccgcaagaacggcaagaaggugauccagcugagccggaagaccuucgacuccgaguacgucaagacccgcgccaacgacugggacuucguggugacgaccgacaucagcgagaugggggcgaacuucaaggccgagcgggucaucgacccccgccggugcaugaagcccgugauccugaccgacggcgaggagcgcgugauccucgccgggcccaugccggucacccacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacgcccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuacaagguggcggccgagggcaucaacuacgccgaccgccgguggugcuucgacgggaucaagaacaaccagauccuggaggagaacguggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucacggagauggggcgccugcccaccuucaugacccagaaggcccggaacgcccuggacaaccucgcggugcugcacaccgccgaggccggcgggaaggccuacaaccacgcccugagcgagcuccccgagacgcuggagacccugcuccugcugacccuccuggcgaccgucacgggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucacggugguggccgccaccauggccaacgagaugggguuccuggagaagaccaagaaggaccugggccucggcagcaucaccacgcaggagagcgaguccaacauccuggacaucgaccugcggccggccagcgcguggacccucuacgccgucgccaccaccuucgugacgcccaugcugcgccacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacccugacggccgcccuccugcugcucguggcgcacuacgccaucaucggccccggccugcaggccaaggccacccgggaggcccagaagcgcgcggccgccgggaucaugaagaaccccaccguggacggcaucaccgucaucgaccuggagcccaucccguacgaccccaaguucgagaagcagcucgggcaggucaugcugcugauccucugcgugacgcagguccugaugaugcggaccaccugggcccugugcgaggcccucacccuggcgacgggccccaucuccacccugugggaggggaaccccggccgcuucuggaacaccaccaucgccgugagcauggccaacaucuuccgcggcuccuaccucgccggggcgggccugcuguucagcaucaugaagaacacgaccaacacccggcgcgggaccggcaacaucggcgagacgcucggggagaaguggaagucccggcugaacgcccugggcaagagcgaguuccagaucuacaagaaguccgggauccaggagguggaccgcacccucgccaaggagggcaucaagcgcggggagaccgaccaccacgccgucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugacgaagggcggccccgggcacgaggagcccauccccauguccaccuacggcuggaaccuggugcggcuccagagcgggguggacgucuucuucaccccgcccgagaagugcgacacccugcugugcgacaucggcgagagcucccccaaccccacgaucgaggcgggccgcacccuccgggugcugaaccugguggagaacuggcucaacaacaacacccaguucugcaucaagguccugaacccguacaugcccagcgugaucgagaagauggagacccugcagcgcaaguacgggggcgcccucgugcggaacccccugucccgcaacagcacccacgagauguacugggucuccaacgccacggggaacaucgugagcuccgugaacaugaucagccggaugcugaucaaccgcuucaccaugaagcacaagaaggccaccuacgagccggacgucgaccugggcuccgggacccggaacaucggcaucgagagcgagauccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgcgagcuccauggugaacggggugguccgccugcugacgaagcccugggacguggugccgauggucacccagauggccaugaccgacaccacgcccuucggccagcagcggguguucaaggagaagguggacacccgcacccaggagcccaaggagggcaccaagaagcucaugaagaucacggccgaguggcuguggaaggagcuggggaagaagaagacgccccggaugugcacccgcgaggaguucacccggaagguccgcagcaacgccgcccucggcgcgaucuucacggacgagaacaaguggaaguccgcccgggaggccguggaggacgggcgcuucugggagcugguggaccgggagcgcaaccugcaccucgagggcaagugcgagaccugcgucuacaacaugauggggaagcgggagaagaagcugggcgaguucggcaaggccaaggggagccgcgcgaucugguacauguggcugggcgcccgguuccucgaguucgaggcccugggguuccugaacgaggaccacugguucucccgcggcaacagccucagcgggguggagggcgagggccugcaccggcugggguacauccuccgcgacgucuccaagaaggagggcggggccauguacgccgacgacaccgcgggcugggacacccggaucacgcuggaggaccugaagaacgaggagauggugaccaaccacaugaagggggagcacaagaagcucgccgaggccaucuucaagcugaccuaccagaacaaggugguccgcgugcagcggccgacgccccggggcacggugauggacaucaucagccggcgcgaccagcgcggcuccgggcaggucggcaccuacgggcugaacaccuucaccaacauggaggcccagcucauccggcagauggagggcgagggcaucuucaagagcauccagcaccugacggugaccgaggagaucgccgugcagaacuggcuggcgcgcgucgggcgggagcgccucucccggauggccaucagcggcgacgacugcguggugaagcccaucgacgaccgcuucgccuccgcccugaccgcccugaacgacauggggaagguccggaaggacauccagcagugggagcccagccgcggcuggaacgacuggacccaggugccguucugcucccaccacuuccacgagcucgugaugaaggacgggcggguccugguggugcccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccguccccagccacugggugcccaccucccgcaccaccuggagcauccacgccaagcacgaguggaugacgaccgaggacaugcuggcgguguggaaccgggucuggauccaggagaacccguggauggaggacaagacccccguggaguccugggaggaggugcccuaccucgggaagcgcgaggaccaguggugcggcagccugaucgggcugaccagccgggccacgugggccaagaacauccagaccgccaucaaccagguccgcucccucaucggcaacgaggaguacaccgacuacaugcccagcaugaagcgcuuccggcgcgaggaggaggaggccggcgugcugugguga

SEQ ID NO: 9356 - RNA, 9876 nt, Artificial Sequence
  derived and/or modified CDS sequence (opt1) from DENV-2__EU482546__SS-prME
accgccggcgucaucgucaugcugauccccaccgugauggccuuccaccucaccacccgcaacggggagccccacaugaucgugggccggcaggagaaggggaagucccugcuguucaagaccgaggacggcaucaacaugugcacccucauggcgaucgaccugggggagcugugcgaggacaccaucaccuacaagugcccccuccugaagcagaacgagcccgaggacaucgacugcuggugcaacagcaccagcaccugggucaccuacgggaccugcaccaccacgggcgagcaccgccgggagaagcgcuccguggcccuggugccccacgucgggaugggccucgagacccggaccgagaccuggaugagcuccgagggggccuggaagcacgugcagcgcaucgagacguggauccugcggcacccgggcuucaccaucauggccgccauccuggcguacaccaucgggaccacgcacuuccagcgcgcccucaucuucauccugcugaccgccguggcccccagcaugaccaugcggugcaucggcaucuccaaccgcgacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccaugguggaccgcggcugggggaacggcugcgggcuguucggcaagggcgggaucgugaccugcgccauguucacgugcaagaagaacauggagggcaagguggugcagcccgagaaccuggaguacaccaucgucaucacgccccacagcggggaggagcacgcggugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgccaagaagcaggacgucgugguccucgggucccaggagggcgcgaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggccgagccgcccuucggcgacuccuacaucaucaucgggguggagccgggccagcugaagcucaacugguucaagaaggggagcuccaucggccagauguucgagacgaccaugcgcggcgcgaagcgcauggccauccugggggacaccgccugggacuucggcagccucggcggggucuucaccuccaucgggaaggcccuccaccagguguucggggccaucuacggcgcggccuucagcgggguguccuggacgaugaagauccugaucggcgucaucaucaccuggaucgggaugaacagccgguccaccagccuguccgugagccuggugcucgucggcguggugacccuguaccugggggccaugguccaggccgacuccggcugcguggugagcuggaagaacaaggagcucaagugcggcuccgggaucuucaucacggacaacguccacaccuggaccgagcaguacaaguuccagcccgagagccccagcaagcuggcguccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggccaagaugcucagcaccgagucccacaaccagaccuuccugaucgacgggcccgagaccgcggagugcccgaacacgaaccgcgccuggaacagccuggaggucgaggacuacggcuucgggguguucaccaccaacaucuggcucaagcugcgggagaagcaggacgccuucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaaccaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacccgggucggcacgaagcacgcgauccugcucguggccgugagcuucgucacccugaucaccgggaacauguccuuccgcgaccugggccgggugauggugauggucggggccaccaugacggacgacaucggcaugggcgugaccuaccucgcccugcuggccgcguucaaggugcgccccaccuucgccgccgggcuccugcugcgcaagcucaccagcaaggagcugaugauggccacgaucggcaucgcccugcucucccagagcaccauccccgagaccauccuggagcugaccgacgcgcucgcccuggggaugaugguccugaagaucgugcggaacauggagaaguaccagcucgccgugacgaucauggccaucuccugcgucccgaacgccgugauccugcagaacgcguggaaggugagcugcaccauccuggccgccgucuccgugagcccccuccugcugaccuccagccagcagaaggccgacuggaucccccucgcgcugaccaucaagggccugaaccccacggccaucuuccucaccacccugucccgcaccagcaagaagcgguccuggccgcugaacgaggccaucauggccgucggcauggugagcauccucgccuccagccugcugaagaacgacauccccaugacggggccccucguggcgggcgggcugcugaccgucugcuacgugcucaccggccgcagcgccgaccuggagcuggagcgggccgccgacgugaagugggaggaccaggccgagaucuccgggagcucccccauccucagcaucaccaucuccgaggacggcagcauguccaucaagaacgaggaggaggagcagacgcugaccauccugauccgcaccggccuccuggucaucagcgggguguucccgguguccauccccaucaccgcggccgccugguaccugugggaggucaagaagcagcgggccggcgugcucugggacgugcccagcccgccgcccgucgggaaggccgagcuggaggacggcgcguaccgcaucaagcagcggggguuccugggcuacucccagaucggcgccgggguguacaaggagggcaccuuccacacgauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggcggugcagaccaagcccggcaucuucaagaccaacacggggaccaucggcgccgugagccuggacuucucccccggcaccagcgggucccccaucgucgaccgcaagggcaaggugguggggcucuacggcaacggcgucgugacccggagcggggccuacguguccgccaucgcgcagacggagaaguccaucgaggacaaccccgagaucgaggacgacaucuuccgcaagaagcggcugaccaucauggaccugcaccccggcgccgggaagaccaagcgcuaccuccccgccaucguccgggaggccaucaagcgcggccugcggacccugauccuggccccgacgcgcgugguggcggccgagauggaggaggcccuccgcgggcugcccauccgguaccagacccccgccauccgcgccgagcacaccggccgggagaucgucgaccugaugugccacgcgaccuucacgaugcgccuccugagccccgugcgggugccgaacuacaaccugaucaucauggacgaggcccacuucaccgaccccgccuccaucgccgcccgcggcuacaucagcacccgggucgagaugggggaggcggccggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgugugguucgucccguccaucaaggcgggcaacgacaucgccgccugccuccggaagaacggcaagaaggugauccagcugagccgcaagaccuucgacuccgaguacgugaagacgcgggccaacgacugggacuucgucgugaccaccgacaucagcgagaugggggccaacuucaaggcggagcgcgugaucgacccccggcgcugcaugaagcccgucauccugaccgacggcgaggagcgggugauccucgccgggcccaugccggugacgcacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgccgcggagggcaucaacuacgccgaccggaaguggugcuucgacgggaucaagaacaaccagauccuggaggagaacguggagguggagaucuggaccaaggagggcgagcgcaagaagcucaagccgcgguggcuggacgcccgcaucuacagcgacccccuggcccucaaggaguucaaggaguucgcggccggccggaagucccugacgcugaaccucaucaccgagauggggcgccugcccaccuucaugacccagaaggcccggaacgcccuggacaaccucgccguccugcacacggcggaggccggcgggcgcgccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucguccuccugauccccgagcccgagaagcagcggacgccccaggacaaccagcugacguacguggugaucgccauccucaccgucguggcggccaccauggccaacgagaugggguuccuggagaagaccaagaaggaccugggccucggcagcaucacgacccaggagagcgaguccaacauccuggacaucgaccugcgcccggccagcgccuggacccucuacgcgguggccaccacguucgucacccccaugcugcggcacuccaucgagaacagcuccgugaacgugagccugaccgccaucgccaaccaggcgaccguccucauggggcugggcaagggguggccccuguccaagauggacaucggcgugccccuccuggccaucgggugcuacagccaggugaacccgaucacgcugaccgccgcccuccugcugcucgucgcccacuacgcgaucaucggccccggccugcaggccaaggccacccgcgaggcccagaagcgggccgcggccgggaucaugaagaaccccaccguggacggcaucacggugaucgaccuggagcccaucccguacgaccccaaguucgagaagcagcucgggcaggucaugcugcugauccucugcgugacccaggugcugaugaugcgcaccaccugggcccugugcgaggcccucacgcuggccaccggccccaucuccacccugugggaggggaaccccggccgguucuggaacaccacgaucgcggucagcauggccaacaucuuccgcggcuccuaccucgccggggccggccugcuguucagcaucaugaagaacaccaccaacacccgccgggggacgggcaacaucggcgagacccucggggagaaguggaagucccgccugaacgcgcugggcaagagcgaguuccagaucuacaagaaguccgggauccaggagguggaccggacccucgccaaggagggcaucaagcgcggggagaccgaccaccacgccgugagccggggcuccgccaagcugcgcugguucgucgagcggaacauggugacgccggagggcaagguggucgaccuggggugcggccgcgggggcuggagcuacuacugcgggggccucaagaacgugcgggaggugaagggccugaccaagggcggccccgggcacgaggagcccauccccauguccaccuacggcuggaaccugguccgccuccagagcgggguggacguguucuucaccccgcccgagaagugcgacacgcugcugugcgacaucggcgagagcucccccaaccccaccaucgaggccggccggacccuccgcguccugaaccugguggagaacuggcucaacaacaacacccaguucugcaucaaggugcugaacccguacaugcccagcgucaucgagaagauggagacccugcagcggaaguacgggggcgcgcucgugcgcaacccccugucccggaacagcacgcacgagauguacuggguguccaacgccaccgggaacaucgucagcuccgugaacaugaucagccgcaugcugaucaaccgguucaccaugaagcacaagaaggccaccuacgagccggacguggaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggucaacgggguggugcgccugcugaccaagcccugggacgucgugccgauggugacccagauggcgaugaccgacacgacccccuucggccagcagcgcgucuucaaggagaagguggacacccggacccaggagcccaaggagggcacgaagaagcucaugaagaucaccgccgaguggcuguggaaggagcuggggaagaagaagacgccccgcgugugcacccgggaggaguucacgcgcaagguccggagcaacgccgcccucggcgccaucuucaccgacgagaacaaguggaaguccgcgcgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacgucggcaagaaggagggcggcgccauguacgccgacgacaccgccgggugggacacgcgcaucacccuggaggaccugaagaacgaggagauggugaccaaccacaugaagggcgagcacaagaagcucgcggaggccaucuucaagcugaccuaccagaacaaggugguccgggugcagcgcccgacgccccggggcaccgugauggacaucaucucccgccgggaccagcgcgggagcggccaggucgggaccuacggccugaacaccuucacgaacauggaggcccagcucauccgccagauggagggcgaggggaucuucaaguccauccagcaccugaccgccaccgaggagaucgccgugcagaacuggcuggcgcgggugggccgcgagcggcucagccgcauggccaucuccggggacgacugcgucgugaagcccaucgacgaccgguucgccagcgcccugaccgcccugaacgacaugggcaaggugcgcaaggacauccagcagugggagcccucccggggguggaacgacuggacgcaggucccguucugcagccaccacuuccacgagcucgugaugaaggacggccgcgugcuggucgugcccugccggaaccaggacgagcugaucggccgcgcgcggaucucccagggggccggcuggagccucaaggagaccgccugccuggggaaguccuacgcccagauguggacccugauguacuuccaccgccgggaccuccgccuggccgcgaacgccaucugcagcgccgugcccucccacuggguccccaccagccggaccacgugguccauccacgccaagcacgaguggaugaccaccgaggacaugcuggcgguguggaaccgcguguggauccaggagaacccguggauggaggacaagacccccgucgagagcugggaggaggugcccuaccucggcaagcgggaggaccaguggugcgggucccugaucggccugacgagccgcgccaccugggccaagaacauccagaccgccaucagccaggugcggucccucaucggcaacgaggaguacaccgacuacaugcccagcaugaagcgcuuccgccgggaggaggaggaggccgggguccugugguga

SEQ ID NO: 9357 - RNA, 9876 nt, Artificial Sequence
  derived and/or modified CDS sequence (opt1) from DENV-2__EU482550__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcgguacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgugauggccgugggcauggucagcauccuggccuccagccuccugaagaacgacauccccaugaccgggccccugguggccggcgggcuccugaccgugugcuacguccugacgggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucaccauccugauccggacgggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacccgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugagccuggacuucucccccggcacgagcgggucccccaucguggaccggaagggcaaggucguggggcuguacggcaacggcguggucacccgcagcggggccuacguguccgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucagccccguccgcgugccgaacuacaaccugaucaucauggacgaggcgcacuucaccgaccccgccuccaucgccgcccggggcuacaucagcacgcgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggccggcaacgacaucgcggccugccugcgcaagaacggcaagaaggucauccagcucagccggaagaccuucgacuccgaguacgugaagacccgcgccaacgacugggacuucguggucaccacggacaucagcgagaugggggccaacuuccgggccgagcgcgugaucgacccccggcgcugcaugaagcccgugauccugaccgacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccugagcgagcugcccgagacccucgagacgcugcugcuccugacccugcucgccaccgugaccggcggcaucuuccuguuccugauguccgggaagggcaucgggaagaugacgcucggcaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaucacccaggagagcgaguccaacauccucgacaucgaccugcgcccggccagcgccuggacccuguacgccguggccacgaccuucgucacccccaugcuccggcacuccaucgagaacagcuccgugaacgugagccugaccgcgaucgccaaccaggccacgguccugauggggcucggccgcggguggccccuguccaagauggacaucggcgugccccugcucgccaucgggugcuacagccaggugaacccgaucacccugaccgcggcccugcuccugcuggucgcccacuacgccaucaucggccccggccuccaggccaaggcgacccgcgaggcccagaagcgggccgccgccgggaucaugaagaaccccacgguggacggcaucaccgugaucgaccuggagcccaucccguacgaccccaaguucgagaagcagcuggggcaggucaugcuccuggugcugugcgugacccagguccucaugaugcgcaccacgugggcgcugugcgaggcccugacccucgccaccggccccaucuccacccugugggaggggaaccccggccgguucuggaacacgaccaucgccgugagcauggccaacaucuuccgcggcuccuaccuggcgggggccggccuccuguucagcaucaugaagaacaccaccaacacgcggcgcgggaccggcaacaucggcgagacccugggggagaaguggaagucccggcucaacgcccugggcaagagcgaguuccagaucuacaagaaguccgggauccaggagguggaccgcacccuggccaaggagggcaucaagcgcggggagacggaccaccacgcggucagccgcggcuccgccaagcuccggugguucguggagcgcaacauggugaccccggagggcaaggucguggaccuggggugcggccgcggcggguggagcuacuacugcggcgggcugaagaacgugcgcgaggucaaggggcucaccaagggcgggcccgggcacgaggagcccauccccauguccaccuacggcuggaaccuggugcggcugcagagcgggguggacgucuucuucacgccgcccgagaagugcgacacccuccugugcgacaucggcgagagcucccccaaccccaccaucgaggccggccgcacccugcgggugcucaaccugguggagaacuggcugaacaacaacacgcaguucugcaucaagguccucaacccguacaugcccagcgugaucgagaagauggagacccugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucaccaugaagcacaagaaggcgacguacgagccggacgucgaccugggcuccgggacccgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacgggguggucaagcuccugaccaagcccugggacguggugccgauggucacccagauggccaugacggacaccacccccuucggccagcagcgcguguucaaggagaagguggacacccggacgcaggagcccaaggagggcaccaagaagcugaugcgcaucaccgccgaguggcucuggaaggagcuggggaagaagaagacgccccggaugugcacgcgcgaggaguucacccggaagguccgcuccaacgcggcccugggcgccaucuucaccgacgagaacaaguggaaguccgcccgggaggccguggaggacucccgcuucugggagcucgucgaccgggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgggaacagccugagcggcguggagggggagggccuccacaagcugggcuacauccugcgggacgucuccaagaaggagggcggcgcgauguacgccgacgacacggccgggugggacacccgcaucacccucgaggaccugaagaacgaggagauggugaccaaccacaugaagggcgagcacaagaagcuggccgaggccaucuucaagcucacguaccagaacaaggugguccgggugcagcgcccgacgccccgggggaccgugauggacaucaucagccggaaggaccagcgcggcuccggccaggucgggaccuacggccugaacacguucaccaacauggaggcgcagcugauccggcagauggagggggagggcaucuucaagagcauccagcaccucaccgugaccgaggagaucgccgugcagaacuggcuggcccgcgucggccgggagcgccugucccggauggccaucagcggggacgacugcguggugaagccccucgacgaccgcuucgccuccgcgcugacggcccugaacgacaugggcaagguccggaaggacauccagcagugggagcccagccgcggguggaacgacuggacccaggugccguucugcucccaccacuuccacgagcucgugaugaaggacggccggguccugguggugcccugccgcagccaggacgagcugaucgggcgggcccgcaucucccagggcgccggcuggagccucaaggagaccgccugccuggggaaguccuacgcgcagauguggacccugauguacuuccaccggcgcgaccuccggcuggccgccaacgccaucugcagcgccguccccucccacugggugcccacgagccgcaccaccugguccauccacgcgaagcacgaguggaugaccaccgaggacaugcuggccguguggaaccgggucuggauccaggagaacccguggauggaggacaagacgcucguggagagcugggaggaggugcccuaccugggcaagcgcgaggaccaguggugcgggagccugaucggccucaccucccgcgccaccugggccaagaacauccagaccgcgaucaaccagguccggagccugaucgggaacgaggaguacacggacuacaugcccuccaugaagcgcuuccggaaggaggaggaggaggccggcgugcugugguga

SEQ ID NO: 9358 - RNA, 9876 nt, Artificial Sequence
  derived and/or modified CDS sequence (opt1) from DENV-2__EU482551__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaccauggccgcgauccuggccuacaccaucgggaccacccacuuccagcgggugcucaucuucauccugcugaccgccguggcccccagcaugaccaugcgcugcaucggcaucuccaaccgggacuucgucgagggcgugagcgggggcuccuggguggacaucguccucgagcacgggagcugcgugacgaccauggcgaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacacgaucgucaucacgccccacagcggggaggagcacgcggugggcaacgacaccgggaagcacggcaaggagaucaagaucaccccgcaguccagcaucaccgaggccgagcucacgggguacggcaccgugaccauggagugcagcccccggaccggccuggacuucaacgagaugguccugcuccagauggaggacaaggccuggcuggugcaccggcagugguuccuggaccucccccugcccuggcugccgggggccgacacgcagggcagcaacuggauccagaaggagacccucgugaccuucaagaacccccacgccaagaagcaggacgucgugguccuggggucccaggagggcgcgaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgugaaggagaucgccgagacgcagcacgggaccaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagacgaccaugcgcggcgcgaagcggauggccauccugggggacaccgccugggacuucggcagccucgggggcgucuucaccuccaucgggaaggcccugcaccagguguucggcgccaucuacggcgcggccuucagcgggguguccuggacgaugaagauccugaucggcgucaucaucaccuggaucgggaugaacagccgcuccaccagccuguccgugagccucgugcuggucggcaucgugacccuguaccucggggugaugguccaggccgacacgggcugcgugguguccuggaagaacaaggagcugaagugcggcagcgggaucuucaucaccgacaacguccacaccuggaccgagcaguacaaguuccagcccgagucccccagcaagcuggccagcgcgauccagaaggcccacgaggagggcaucugcgggauccgguccgugacgcgccucgagaaccugauguggaagcagaucacccccgagcugaaccacauccucagcgagaacgaggugaagcugaccaucaugaccggcgacaucaaggggaucaugcaggccggcaagcggucccugcgcccgcagcccacggagcucaaguacagcuggaagaccuggggcaaggccaagaugcuguccaccgagagccacaaccagaccuuccugaucgacgggcccgagacggccgagugcccgaacaccaaccgggcguggaacucccucgaggucgaggacuacggcuucgggguguucagcaccaacaucuggcugaagcugcgcgagaagcaggacguguucugcgacuccaagcucaugagcgccgccaucaaggacaaccgggccguccacgccgacaugggcuacuggaucgaguccgcgcugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacgcagaccgccgggcccuggcaccugggcaagcuggagauggacuucgacuucugcgaggggaccaccgucguggugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgcggggcacggccagaucgacaacuucucccugggcgugcuggggauggcccucuuccuggaggagaugcugcggacccgcgucggcacgaagcacgccauccuccugguggccgugagcuucgucacccugaucaccgggaacauguccuuccgggaccucggccgcgugauggugauggucggggcgaccaugacggacgacaucggcaugggcgugaccuaccuggcccugcucgccgccuucaaggugcgccccaccuucgccgcggggcugcugcuccggaagcugaccagcaaggagcugaugauggccacgaucggcaucgcccuccugucccagagcaccauccccgagaccauccuggagcucaccgacgcccuggcccuggggaugaugguccucaagaucgugcgcaacauggagaaguaccagcuggcggugacgaucauggccaucuccugcgucccgaacgccgugauccugcagaacgccuggaaggugagcugcaccauccucgccgcggucuccgugagcccccugcugcucaccuccagccagcagaaggccgacuggaucccccuggcccugaccaucaagggccucaaccccacggccaucuuccugaccacccugucccggaccagcaagaagcgcuccuggccgcucaacgaggcggucauggccgugggcauggugagcauccuggccuccagccugcucaagaacgacauccccaugacggggccccuggucgccggcgggcugcucaccgugugcuacgugcugaccggccggagcgccgaccuggagcucgagaaggcggccgacgucaagugggaggaccaggccgagaucuccgggagcucccccauccugagcaucaccaucuccgaggacggcagcauguccaucaagaacgaggaggaggagcacacgcugaccauccucauccgcaccggccugcuggugaucagcgggguguucccggucuccauccccaucaccgccgccgcgugguaccucugggaggugaagaagcagcgggccggcgugcugugggacguccccagcccgccgcccguggggaaggccgagcuggaggacggcgccuaccgcaucaagcagcgggggaucuucggcuacucccagaucggcgccgggguguacaaggagggcaccuuccacacgauguggcacgucacccgcggggcggugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggccuguucaagaccaacacggggaccaucggcgccgucagccucgacuucucccccggcaccagcgggucccccaucguggaccgcaagggcaagguggucgggcuguacggcaacggcguggugacccggagcggggcguacgucuccgccaucgcccagacggagaaguccaucgaggacaaccccgagaucgaggacgacaucuuccgcaagaagcggcugaccaucauggaccuccaccccggcgccgggaagaccaagcgcuaccugcccgcgaucgugcgggaggccaucaagcgcggccugcggacccugauccucgccccgacgcgcguggucgccgccgagauggaggaggcgcugcgcgggcugcccauccgguaccagacccccgccauccgcgccgagcacaccggccgggagaucguggaccucaugugccacgccaccuucacgaugcgccugcugagccccgugcgggucccgaacuacaaccucaucaucauggacgaggcccacuucaccgaccccgcguccaucgccgcccgcggcuacaucagcacccggguggagaugggggaggccgccggcaucuucaugaccgcgacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgccgcgugccugcggaagaacggcaagaaggugauccagcugagccgcaagaccuucgacuccgaguacgucaagacgcgggccaacgacugggacuucguggugaccaccgacaucagcgagaugggggccaacuuccgcgccgagcgggucaucgacccccgccggugcaugaagcccgugauccucaccgacggcgaggagcgcgugauccuggccgggcccaugccggucacgcacuccagcgcggcccagcggcgcggccgcaucgggcggaaccccaagaacgagaacgaccaguacaucuacaugggcgagccccuggagaacgacgaggacugcgcccacuggaaggaggccaagaugcuccuggacaacaucaacacccccgagggcaucaucccguccauguucgagcccgagcgcgagaagguggacgccaucgacggggaguaccggcugcgcggcgaggcgcggaagaccuucguggaccucaugcgccgcggggaccugcccgucuggcuggccuaccgcguggccgccgagggcaucaacuacgccgaccggcgcuggugcuucgacgggaucaagaacaaccagauccucgaggagaacguggaggucgagaucuggaccaaggagggcgagcggaagaagcugaagccgcgcuggcuggacgcgcggaucuacagcgacccccucgcccugaaggaguucaaggaguucgccgccggccgcaagucccugacgcucaaccugaucaccgagauggggcggcugcccaccuucaugacccagaaggcgcgcgacgcccucgacaaccuggccgugcugcacacggccgaggucggcgggcgggccuacaaccacgcgcucagcgagcugcccgagacccuggagacccuccugcugcucacccugcuggccacggugaccggcggcaucuuccucuuccugauguccgggaagggcaucgggaagaugacccugggcaugugcugcaucaucaccgccagcauccuccugugguacgcccagauccagccgcacuggaucgccgcguccaucauccuggaguucuuccucaucgugcugcugauccccgagcccgagaagcagcgcacgccccaggacaaccagcucacguacgucgugaucgccauccugaccguggucgccgccaccauggccaacgagaugggguuccuggagaagaccaagaaggaccucggccugggcagcaucacgacccaggagagcgaguccaacauccuggacaucgaccuccggccggcgagcgccuggacccuguacgccguggccaccacguucgugacccccaugcugcgccacuccaucgagaacagcuccgucaacgugagccucaccgccaucgcgaaccaggccaccgugcugauggggcugggccggggguggccccucuccaagauggacaucggcgucccccugcuggccaucgggugcuacagccaggugaacccgaucacgcucaccgccgcgcugcugcuccugguggcccacuacgccaucaucggccccggccugcaggccaaggccacccgcgaggcgcagaagcgcaccgccgccgggaucaugaagaaccccacggucgacggcaucaccgugaucgaccucgagcccaucccguacgaccccaaguucgagaagcagcuggggcaggucaugcugcucguccugugcgugacccaggugcugaugaugcggaccacgugggcccucugcgaggcccugacccuggcgaccggccccaucuccacccucugggaggggaaccccggccgcuucuggaacacgaccaucgccgucagcauggccaacaucuuccggggcuccuaccuggccggggccggccuccucuucagcaucaugaagaacaccaccaacacgcgccgggggaccggcaacaucggcgagacccugggggagaaguggaagucccgccugaacgcgcucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcgggcccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcgugaagguccugaacccguacaugcccagcgugaucgagaagauggagacgcuccagcggaaguacgggggcgcccuggugcgcaacccccugucccggaacagcacccacgagauguacugggucuccaacgccaccgggaacaucgugagcuccgugaacaugaucagccgcaugcugaucaaccgcuucaccaugaagcacaagaaggccacguacgagccggacgucgaccucggcuccgggacccggaacaucggcaucgagaacgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgcguccagcauggugaacgggguggucaagcugcucaccaagcccugggacguggugccgauggucacccagauggccaugacggacaccacccccuucggccagcagcggguguucaaggagaagguggacacccgcacgcaggagcccaaggagggcaccaagaagcugaugcggaucaccgccgaguggcuguggaaggagcucgggaagaagaagacgccccgcaugugcacgcgggaggaguucacccgcaagguccgguccaacgccgcccugggcgcgaucuucaccgacgagaacaaguggaaguccgcccgcgaggccguggaggacucccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcacaagcucggcuacauccugcgcgacgucuccaagaaggagggcggggccauguacgccgacgacacggcggggugggacacccggaucacccuggaggaccucaagaacgaggagauggugaccaaccacaugaagggcgagcacaagaagcuggccgaggccaucuucaagcugacguaccagaacaaggugguccgcgugcagcggccgacgccccgcgggaccgugauggacaucaucagccgcaaggaccagcggggcuccggccaggucgggaccuacggccucaacacguucaccaacauggaggcccagcugauccgccagauggagggggagggcaucuucaagagcauccagcggcugaccgugaccgaggagaucgccgugcagaacuggcucgcgcgcgucggccgggagcgccugucccggauggccaucagcggggacgacugcguggugaagccccuggacgaccgcuucgccuccgcccucacggcccugaacgacaugggcaagguccggaaggacauccagcagugggagcccagccgcggguggaacgacuggacccaggugccguucugcucccaccacuuccacgagcuggugaugaaggacggccggaugcucgucgugcccugccgcaaccaggacgagcugaucgggcgggcgcgcaucagccagggcgccggcuggucccugaaggagaccgccugccucggcaagagcuacgcccagauguggacccugauguacuuccaccggcgcgaccugcggcucgccgcgaacgccaucugcuccgccgugcccagccacuggguccccaccucccgcacgaccuggagcauccacgccaagcacgaguggaugaccaccgaggacaugcuggccguguggaaccggguguggauccaggagaacccguggauggaggacaagacgcccgucgaguccugggaggaggugcccuaccugggcaagcgcgaggaccaguggugcgggagccucaucggccugaccagccgcgcgaccugggccaagaacauccagaccgccaucaaccaggugcggucccugaucgggaacgaggaguacacggacuacaugcccagcaugaagcgcuuccggaaggaggaggaggaggccggcguccucugguga

SEQ ID NO: 9359 - RNA, 9876 nt, Artificial Sequence
  derived and/or modified CDS sequence (opt1) from DENV-2__EU482552__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaccgggaaggcccugcaccaggucuucggcgcgaucuacggcgccgccuucagcgggguguccuggacgaugaagauccugaucggcgugaucaucaccuggaucgggaugaacagccgcuccaccagccuguccgucagccucgugcuggugggcgucgugacccuguaccucggggugaugguccaggccgacacgggcugcgugguguccuggaagaacaaggagcugaagugcggcagcgggaucuucaucaccgacaacguccacaccuggaccgagcaguacaaguuccagcccgagucccccagcaagcuggcgagcgccauccagaaggcccacgaggagggcaucugcgggauccgguccgugacgcgccucgagaaccugauguggaagcagaucacccccgagcugaaccacauccucagcgagaacgaggugaagcugaccaucaugaccggcgacaucaaggggaucaugcaggccggcaagcggucccugcgcccgcagcccacggagcucaaguacagcuggaagaccuggggcaaggccaagaugcuguccaccgagagccacaaccagaccuuccugaucgacgggcccgagacggcggagugcccgaacaccaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacgcagaccgccgggcccuggcaccugggcaagcuggagauggacuucgacuucugcgaggggaccaccgucguggugacggaggacugcggcaaccggggccccagccuccgcaccaccaccgcgagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccggguacggccagaucgacaacuucucccugggcgugcuggggauggcccucuuccuggaggagaugcugcggacccgcgucggcacgaagcacgccauccuccugguggcggugagcuucgucacccugaucaccgggaacauguccuuccgggaccucggccgcgugauggugauggucggggccaccaugacggacgacaucggcaugggcgugaccuaccuggcccugcucgccgccuucaaggugcgccccaccuucgcggccgggcugcugcuccggaagcugaccagcaaggagcugaugauggccacgaucggcaucgcccuccugucccagagcaccauccccgagaccauccuggagcucaccgacgcccuggcgcuggggaugaugguccucaagaucgugcgcaacauggagaaguaccagcuggccgugacgaucauggccaucuccugcgucccgaacgccgugauccugcagaacgccuggaaggugagcugcaccauccucgcggccgucuccgugagcccccugcugcucaccuccagccagcagaaggccgacuggaucccccuggcccugaccaucaagggccucaaccccacggcgaucuuccugaccacccugucccggaccagcaagaagcgcuccuggccgcucaacgaggccaucauggccgucggcauggugagcauccuggccuccagccugcucaagaacgacauccccaugacggggccccugguggccggcgggcugcucaccgucugcuacgugcugaccggccggagcgcggaccuggagcucgagcgcgccgccgacgugaagugggaggaccaggccgagaucuccgggagcucccccauccugagcaucaccaucuccgaggacggcagcauguccaucaagaacgaggaggaggagcacacgcugaccauccucauccggaccggccugcuggucaucagcgggguguucccgguguccauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacucccagaucggcgcggggguguacaaggagggcaccuuccacacgauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgccgugcagaccaagcccggccuguucaagaccaacacggggaccaucggcgcggugagccucgacuucucccccggcaccagcgggucccccaucgucgaccggaagggcaaggugguggggcuguacggcaacggcgucgugacccgcagcggggccuacguguccgccaucgcccagacggagaaguccaucgaggacaaccccgagaucgaggacgacaucuuccggaagaagcgccugaccaucauggaccuccaccccggcgcggggaagaccaagcgguaccugcccgccaucguccgcgaggccaucaagcggggccugcgcacccugauccucgccccgacgcgcgugguggccgcggagauggaggaggcccugcgggggcugcccauccgcuaccagacccccgccauccgggccgagcacaccggccgcgagaucgucgaccucaugugccacgccaccuucacgaugcggcugcugagccccgugcgcgugccgaacuacaaccucaucaucauggacgaggcgcacuucaccgaccccgccuccaucgccgcccggggcuacaucagcacccgcgucgagaugggggaggccgcgggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccugcgcaagaacggcaagaaggugauccagcugagccggaagaccuucgacuccgaguacgugaagacgcgcgccaacgacugggacuucgucgugaccaccgacaucagcgagaugggggccaacuuccgggccgagcgcgugaucgacccccggcgcugcaugaagcccgucauccucaccgacggcgaggagcgggugauccuggcggggcccaugccggugacgcacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggagguggagaucuggaccaaggagggcgagcgcaagaagcugaagccgcgguggcuggacgcccgcaucuacagcgacccccucgcccugaaggaguucaaggaguucgccgcgggccggaagucccugacgcucaaccugaucaccgagauggggcgccugcccaccuucaugacccagaaggcccgggacgcccucgacaaccuggccguccugcacacggccgaggugggcgggcgcgcguacaaccacgcccucagcgagcugcccgagacccuggagacccuccugcugcucacccugcuggccacggucaccggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucacguacguggucaucgccauccugaccgugguggccgccaccauggcgaacgagaugggguuccuggagaagaccaagaaggaccucggccugggcagcaucacgacccaggagagcgaguccaacauccuggacaucgaccuccgcccggccagcgccuggacccuguacgccgucgccaccacguucgugacccccaugcugcggcacuccaucgagaacagcuccgugaacgucagccucaccgcgaucgccaaccaggccaccgugcugauggggcugggccgcggguggccccucuccaagauggacaucggcgugccccugcuggccaucgggugcuacagccaggucaacccgaucacgcucaccgcggcccugcugcuccugguggcccacuacgccaucaucggccccggccugcaggccaaggcgacccgcgaggcccagaagcggaccgccgccgggaucaugaagaaccccacgguggacggcaucaccgucaucgaccucgagcccaucccguacgaccccaaguucgagaagcagcugggccaggugaugcugcucgugcugugcgucacccaggugcugaugaugcgcaccacgugggcccucugcgaggcgcugacccuggccaccggccccaucuccacccucugggaggggaaccccggccgguucuggaacacgaccaucgccgugagcauggccaacaucuuccgcggcuccuaccuggccggggcgggccuccucuucagcaucaugaagaacaccaccaacacgcggcgcgggaccggcaacaucggcgagacccugggggagaaguggaagucccggcugaacgcccucggcaagagcgaguuccagaucuacaagaaguccgggauccaggaggucgaccgcacccuggccaaggagggcaucaagcgcggggagacggaccaccacgccgugagccgcggcuccgcgaagcugcggugguucguggagcgcaacauggucaccccggagggcaaggugguggaccucgggugcggccgcggcggguggagcuacuacugcggcgggcugaagaacguccgcgaggugaaggggcugaccaagggcgggcccgggcacgaggagcccauccccauguccaccuacggcuggaaccucgugcggcugcagagcggggucgacguguucuucacgccgcccgagaagugcgacacccugcucugcgacaucggcgagagcucccccaaccccaccaucgaggccggccgcacccugcgggugcugaaccucgucgagaacuggcugaacaacaacacccaguucugcgugaaggugcugaacccguacaugcccagcgucaucgagaagauggagacgcuccagcgcaaguacgggggcgcccuggugcggaacccccugucccgcaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggucaacgggguggugaagcugcucaccaagcccugggacgucgugccgauggugacccagauggccaugacggacaccacccccuucggccagcagcgcgucuucaaggagaagguggacacccggacgcaggagcccaaggagggcaccaagaagcugaugcgcaucaccgccgaguggcuguggaaggagcucgggaagaagaagacgccccggaugugcacgcgcgaggaguucacccggaaggugcgcuccaacgccgcgcugggcgccaucuucaccgacgagaacaaguggaaguccgcccgggaggccgucgaggacucccgcuucugggagcugguggaccgggagcgcaaccuccaccuggaggggaagugcgagaccugcgucuacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacguguccaagaaggagggcggggccauguacgcggacgacacggccgggugggacacccgcaucacccuggaggaccucaagaacgaggagauggucaccaaccacaugaagggcgagcacaagaagcuggccgaggccaucuucaagcugacguaccagaacaagguggugcggguccagcgcccgacgccccgggggaccgugauggacaucaucagccggaaggaccagcgcggcuccggccagguggggaccuacggccucaacacguucaccaacauggaggcccagcugauccggcagauggagggggagggcaucuucaagagcauccagcgccugaccgucaccgaggagaucgcggugcagaacuggcucgcccgggugggccgcgagcggcugucccgcauggccaucagcggggacgacugcgucgugaagccccuggacgaccgguucgccuccgcccucacggcgcugaacgacaugggcaaggugcgcaaggacauccagcagugggagcccagccggggguggaacgacuggacccaggucccguucugcucccaccacuuccacgagcuggugaugaaggacggccgcgugcucgucgugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccgugcccagccacuggguccccaccucccggacgaccuggagcauccacgccaagcacgaguggaugaccaccgaggacaugcuggcgguguggaaccgcguguggauccaggagaacccguggauggaggacaagacgcccgucgaguccugggaggaggugcccuaccugggcaagcgcgaggaccaguggugcgggagccucaucggccugaccagccgggccaccugggccaagaacauccagaccgccaucaaccaggugcgcucccugaucgggaacgaggaguacacggacuacaugcccagcaugaagcgguuccgcaaggaggaggaggaggcgggcguccucugguga

SEQ ID NO: 9360 - RNA, 9876 nt, Artificial Sequence
  derived and/or modified CDS sequence (opt1) from DENV-2__EU482554__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaccgucgugcugcccgagaaccuggaguacacgaucgugaucacgccccacagcggggaggagcacgccgucggcaacgacaccgggaagcacggcaaggagaucaagaucaccccgcaguccagcaucaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccucgagaagcgguacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagacgaccaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggacgaugaagauccugaucggcgugaucaucaccuggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucacggacaacguccacaccuggaccgagcaguacaaguuccagcccgagagccccagcaagcuggcguccgccauccagaaggcccacgaggagggcaucugcgggauccggagcgugacccgccucgagaaccugauguggaagcagaucacgcccgagcugaaccacauccucuccgagaacgaggugaagcugaccaucaugaccggcgacaucaaggggaucaugcaggccggcaagcggagccugcgcccgcagcccaccgagcucaaguacuccuggaagacguggggcaaggccaagaugcugagcaccgagucccacaaccagaccuuccugaucgacgggcccgagaccgcggagugcccgaacacgaaccgggccuggaacagccucgaggucgaggacuacggcuucgggguguucuccaccaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacccgcgugggcaccaagcacgccauccuccugguggcggucuccuucgugacgcugaucaccgggaacaugagcuuccgggaccucggccgcgugauggucauggugggggccaccaugaccgacgacaucggcaugggcgugacguaccuggcccugcucgccgccuucaagguccgccccaccuucgcggccgggcugcugcuccggaagcugaccuccaaggagcugaugauggccaccaucggcaucgcccuccugagccaguccacgauccccgagaccauccuggagcucaccgacgcccuggcgcuggggaugauggugcucaagaucgugcgcaacauggagaaguaccagcuggccgucaccaucauggccauccugugcgugccgaacgccgugauccuccagaacgccuggaaggucagcugcacgauccuggcggccguguccgucagcccccugcuccugaccuccagccagcagaaggccgacuggaucccccuggcccucaccaucaagggccugaaccccaccgcgaucuuccugacgacccucucccggaccagcaagaagcgcuccuggccgcugaacgaggccgugauggccgugggcauggucagcauccuggccuccagccuccugaagaacgacauccccaugaccgggccccugguggccggcgggcuccugacggugugcuacguccugaccggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacgcgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagaccaagcccggccucuucaagaccaacaccgggacgaucggcgcggugagccuggacuucucccccggcaccagcgggucccccaucguggaccggaagggcaaggucguggggcuguacggcaacggcguggucacccgcagcggggccuacguguccgccaucgcccagaccgagaaguccaucgaggacaaccccgagaucgaggacgacaucuuccggaagaagcgccucacgaucauggaccugcaccccggcgcggggaagaccaagcgguaccugcccgccaucgugcgcgaggccaucaagcggggccugcgcacccucauccuggccccgacccgcgucguggccgcggagauggaggaggcccugcgggggcuccccauccgcuaccagacgcccgccauccgggccgagcacaccggccgcgagaucguggaccugaugugccacgccaccuucaccaugcggcugcucagccccguccgcgugccgaacuacaaccugaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggccggcaacgacaucgcggccugccugcgcaagaacggcaagaaggucauccagcucagccggaagaccuucgacuccgaguacgugaagacccgcgccaacgacugggacuucguggucacgaccgacaucagcgagaugggggccaacuuccgggccgagcgcgugaucgacccccggcgcugcaugaagcccgugauccugaccgacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacgcccgagggcaucaucccguccauguucgagcccgagcgggagaagguggacgcgaucgacggggaguaccgccuccggggcgaggcccgcaagaccuucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucacggagauggggcgccuccccaccuucaugacccagaaggcccgggacgcccuggacaaccuggccguccuccacaccgccgaggugggcgggcgcgcguacaaccacgcccugagcgagcugcccgagacgcucgagacccugcugcuccugacccugcucgccaccgugacgggcggcaucuuccuguuccugauguccgggaagggcaucgggaagaugacccucggcaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugacggucguggccgccaccauggcgaacgagaugggguuccucgagaagaccaagaaggaccugggccugggcagcaucaucacccaggagagcgaguccaacauccucgacaucgaccugcgcccggccagcgccuggacgcuguacgccguggccaccaccuucgucacccccaugcuccggcacuccaucgagaacagcuccgugaacgugagccugacggcgaucgccaaccaggccaccguccugauggggcucggccgcggguggccccuguccaagauggacaucggcgugccccugcucgccaucgggugcuacagccaggugaacccgaucacccugaccgcggcccugcuccugcuggucgcccacuacgccaucaucggccccggccuccaggccaaggcgacgcgcgaggcccagaagcgggccgccgccgggaucaugaagaaccccaccguggacggcaucaccgugaucgaccuggagcccaucccguacgaccccaaguucgagaagcagcuggggcaggucaugcuccuggugcugugcgugacccagguccucaugaugcgcacgaccugggcgcugugcgaggcccugacccucgccaccggccccaucuccacgcugugggaggggaaccccggccgguucuggaacaccaccaucgccgugagcauggccaacaucuuccgcggcuccuaccuggcgggggccggccuccuguucagcaucaugaagaacaccacgaacacccggcgcgggaccggcaacaucggcgagacccugggggagaaguggaagucccggcucaacgcccugggcaagagcgaguuccagaucuacaagaaguccgggauccaggagguggaccgcacgcuggccaaggagggcaucaagcgcggggagaccgaccaccacgcggucagccgcggcuccgccaagcuccggugguucguggagcgcaacauggugaccccggagggcaaggucguggaccuggggugcggccgcggcggguggagcuacuacugcggcgggcugaagaacgugcgcgaggucaaggggcucaccaagggcgggcccgggcacgaggagcccauccccauguccacguacggcuggaaccuggugcggcugcagagcgggguggacgucuucuucaccccgcccgagaagugcgacacccuccugugcgacaucggcgagagcucccccaaccccaccaucgaggccggccgcacgcugcgggugcucaaccugguggagaacuggcugaacaacaacacccaguucugcaucaagguccucaacccguacaugcccagcgugaucgagaagauggagacccugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucacgaugaagcacaagaaggcgaccuacgagccggacgucgaccugggcuccgggacccgcaacaucggcaucgagaacgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacggggugguccgccuccugaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcucuggaaggagcuggggaagaagaagacgccccgcaugugcacccgggaggaguucacccgcaagguccgguccaacgcggcccugggcgccaucuucaccgacgagaacaaguggaaguccgcccgcgaggccguggaggacucccgguucugggagcucgucgaccgcgagcggaaccugcaccuggaggggaagugcgagacgugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggggaacagccugagcggcguggagggggagggccuccacaagcugggcuacauccugcgcgacgucuccaagaaggagggcggcgcgauguacgccgacgacaccgccgggugggacacccggaucacccucgaggaccugaagaacgaggagauggugacgaaccacaugaagggcgagcacaagaagcuggccgaggccaucuucaagcucaccuaccagaacaaggugguccgcgugcagcgcccgacgccccgggggaccgugauggacaucaucagccgcaaggaccagcggggcuccggccaggucgggacguacggccugaacaccuucaccaacauggaggcgcagcugauccgccagauggagggggagggcaucuucaagagcauccagcaccucaccgugacggaggagaucgccgugcagaacuggcuggcccgggucggccgcgagcggcugucccgcauggccaucagcggggacgacugcguggugaagccccucgacgaccgguucgccuccgcgcugaccgcccugaacgacaugggcaagguccgcaaggacauccagcagugggagcccagccggggguggaacgacuggacccaggugccguucugcucccaccacuuccacgagcucgugaugaaggacggccgcguccugguggugcccugccggagccaggacgagcugaucgggcgcgcccggaucucccagggcgccggcuggagccucaaggagaccgccugccuggggaaguccuacgcgcagauguggacgcugauguacuuccaccgccgggaccuccgccuggccgccaacgccaucugcagcgccguccccucccacugggugcccaccagccggaccaccugguccauccacgcgaagcacgaguggaugaccacggaggacaugcuggccguguggaaccgcgucuggauccaggagaacccguggauggaggacaagacccucguggagagcugggaggaggugcccuaccugggcaagcgcgaggaccaguggugcgggagccugaucggccucaccucccgggccaccugggccaagaacauccagacggcgaucaaccagguccgcagccugaucgggaacgaggaguacaccgacuacaugcccuccaugaagcgguuccgcaaggaggaggaggaggccggcgugcugugguga

SEQ ID NO: 9361 - RNA, 9876 nt, Artificial Sequence
  derived and/or modified CDS sequence (opt1) from DENV-2__EU482556__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggugagccacgagaugguccugcuccagauggaggacaaggccuggcuggugcaccggcagugguuccuggaccucccccugcccuggcugccgggggccgacacccagggcuccaacuggauccagaaggagacgcucgugaccuucaagaacccccacgcgaagaagcaggacgucgugguccuggggagccaggagggcgccaugcacaccgcccugaccggggccacggagauccagaugagcuccggcaaccuccuguucaccggccaccugaagugccgccuccggauggacaagcugcagcugaaggggaugagcuacuccaugugcaccggcaaguucaagaucgugaaggagaucgccgagacccagcacgggacgaucgugauccgcguccaguacgagggcgacggcagccccugcaagauccccuucgagaucauggaccucgagaagcggcacgugcuggggcgccugaucaccgugaacccgaucgucaccgagaaggacucccccgugaacaucgaggcggagccgcccuucggcgacagcuacaucaucaucgggguggagccgggccagcucaagcugaacugguucaagaagggguccagcaucggccagauguucgagaccacgaugcgcggcgccaagcggauggccguccugggggacaccgccugggacuucggcucccucgggggcguguucaccagcaucgggaaggcccugcaccagguguucggcgcgaucuacggcgccgccuucuccggggucagcuggaccaugaagauccugaucggcgugaucaucacguggaucgggaugaacucccgcagcaccucccugagcgugucccucguccuggugggcguggucacccuguaccucggggugauggugcaggccgacaccggcugcgucgugagcuggaagaacaaggagcugaagugcggcuccgggaucuucaucacggacaacgugcacaccuggaccgagcaguacaaguuccagcccgagagccccagcaagcuggcguccgccauccagaaggcccacgaggagggcaucugcgggauccggagcgucacccgccucgagaaccugauguggaagcagaucacgcccgagcugaaccacauccucuccgagaacgaggugaagcugaccaucaugaccggcgacaucaaggggaucaugcaggccggcaagcggagccugcgcccgcagcccaccgagcucaaguacuccuggaagacguggggcaaggccaagaugcugagcaccgagucccacaaccagaccuuccugaucgacgggcccgagaccgcggagugcccgaacacgaaccgggccuggaacagccucgagguggaggacuacggcuucggggucuucuccaccaacaucuggcugaagcugcgcgagaagcaggacguguucugcgacagcaagcucauguccgccgccaucaaggacaaccgggccgugcacgcggacaugggcuacuggaucgagagcgcccugaacgacaccuggaagauggagaaggccuccuucaucgagaucaagagcugccacuggcccaagucccacacccuguggagcaacggcguccucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccguggucgugaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcgugggcaccaagcacgccauccuccuggucgcgguguccuucgugacgcugaucaccgggaacaugagcuuccgggaccucggccgcgucauggugauggugggggccaccaugaccgacgacaucggcaugggcgucacguaccuggcccugcucgccgccuucaaggugcgccccaccuucgcggccgggcugcugcuccggaagcugaccuccaaggagcugaugauggccaccaucggcaucgcccuccugagccaguccacgauccccgagaccauccuggagcucaccgacgcccuggcgcuggggaugauggugcucaagaucguccgcaacauggagaaguaccagcuggccgugaccaucauggccaucagcugcgugccgaacgccgucauccugcagaacgccuggaagguguccugcacgauccucgcggccgucagcgugagcccccugcugcucaccagcucccagcagaaggccgacuggaucccccuggcccugaccaucaagggccucaaccccaccgcgaucuuccugacgacccugagccggaccuccaagaagcgcagcuggccgcucaacgaggccgugauggccgucggcaugguguccauccuggccagcagccugcucaagaacgacauccccaugaccgggccccugguggccggcgggcugcucacggucugcuacgugcugaccggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugacgauccucauccggaccggccugcuggucaucuccgggguguucccggugagcauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacagccagaucggcgcggggguguacaaggagggcaccuuccacaccauguggcacgugacgcgcggggccguccucaugcaccgcggcaagcggaucgagcccuccugggccgacgugaagaaggaccugaucagcuacgggggcggcuggaagcuggagggggaguggaaggagggcgaggaggugcagguccucgcccuggagcccgggaagaacccccgcgccgugcagaccaagcccggccuguucaagaccaacaccgggacgaucggcgcggugucccucgacuucagccccggcaccuccgggagccccaucgucgaccggaagggcaaggugguggggcuguacggcaacggcgucgugacccgcuccggggccuacgugagcgccaucgcccagaccgagaaguccaucgaggacaaccccgagaucgaggacgacaucuuccggaagaagcgccugacgaucauggaccuccaccccggcgcggggaagaccaagcgguaccugcccgccaucguccgcgaggccaucaagcggggccugcgcacccugauccucgccccgacccgcgugguggccgcggagauggaggaggcccugcgggggcugcccauccgcuaccagacgcccgccauccgggccgagcacaccggccgcgagaucgucgaccucaugugccacgccaccuucaccaugcggcugcugucccccgugcgcgugccgaacuacaaccucaucaucauggacgaggcgcacuucacggaccccgccagcaucgccgcccggggcuacaucuccacccgcgucgagaugggggaggccgcgggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgugugguucgucccgagcaucaaggccggcaacgacaucgcggccugccugcgcaagaacggcaagaaggugauccagcugucccggaagaccuucgacagcgaguacgugaagacccgcgccaacgacugggacuucgucgugacgaccgacaucuccgagaugggggccaacuuccgggccgagcgcgugaucgacccccggcgcugcaugaagcccgucauccucaccgacggcgaggagcgggugauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucacggagauggggcgccugcccacccucaugacccagaaggcccgggacgcccuggacaaccuggccgugcuccacaccgccgaggugggcgggcgcgcguacaaccacgcccuguccgagcugcccgagacgcucgagacccugcugcuccugacccugcucgccaccgucacgggcggcaucuuccuguuccugaugagcgggaagggcaucgggaagaugacccucggcaugugcugcaucaucaccgccuccauccugcugugguacgcccagauccagccgcacuggaucgcggccagcaucauccucgaguucuuccugaucgugcugcucauccccgagcccgagaagcagcggacgccccaggacaaccagcugaccuacguggucaucgccauccugacggugguggccgccaccauggcgaacgagaugggguuccucgagaagaccaagaaggaccugggccugggcagcaucaccacgcaggaguccgagagcaacauccucgacaucgaccugcgcccggccuccgccuggacccuguacgccgucgccaccaccuucgugacgcccaugcuccggcacagcaucgagaacuccagcgugaacgucucccugaccgcgaucgccaaccaggccaccgugcugauggggcucggccgcggguggccccugagcaagauggacaucggcgugccccugcucgccaucgggugcuacucccaggucaacccgaucacccugacggcggcccugcuccugcugguggcccacuacgccaucaucggccccggccuccaggccaaggcgacccgcgaggcccagaagcggaccgccgccgggaucaugaagaaccccaccguggacggcaucacggucaucgaccuggagcccaucccguacgaccccaaguucgagaagcagcugggccaggugaugcuccuggugcugugcgucacccaggugcucaugaugcgcaccaccugggcccugugcgaggcgcugacgcucgccaccggccccaucagcacccugugggaggggaaccccggccgguucuggaacaccacgaucgccguguccauggccaacaucuuccgcggcagcuaccuggccggggcgggccuccuguucuccaucaugaagaacaccaccaacacccggcgcgggacgggcaacaucggcgagacccugggggagaaguggaagucccggcucaacgcccugggcaaguccgaguuccagaucuacaagaaguccgggauccaggaggucgaccgcacccuggccaaggagggcaucaagcgcggggagaccgaccaccacgccgugucccgcggcagcgcgaagcuccggugguucguggagcgcaacauggucacgccggagggcaaggugguggaccuggggugcggccgcggcgggugguccuacuacugcggcgggcugaagaacguccgcgaggugaaggggcucaccaagggcgggcccgggcacgaggagcccauccccaugagcaccuacggcuggaaccuggugcggcugcagagcggggucgacguguucuucaccccgcccgagaagugcgacacgcuccugugcgacaucggcgaguccagccccaaccccaccaucgaggccggccgcacccugcgggugcucaaccuggucgagaacuggcugaacaacaacacccaguucugcgugaaggugcucaacccguacaugcccuccgucaucgagaagauggagacccugcagcgcaaguacgggggcgcccuggugcggaacccccugagccgcaacuccacgcacgagauguacugggugagcaacgccaccgggaacaucgucuccagcgugaacaugaucucccgcaugcucaucaaccgguucaccaugaagcacaagaaggccaccuacgagccggacguggaccugggcagcgggacgcgcaacaucggcaucgagaacgagauccccaaccuggacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggucaacgggguggugaagcuccugaccaagcccugggacgucgugccgauggugacccagauggccaugaccgacacgacccccuucggccagcagcgcgucuucaaggagaagguggacacccggacccaggagcccaaggagggcacgaagaagcugaugcgcaucaccgccgaguggcucuggaaggagcuggggaagaagaagacgccccggaugugcacccgcgaggaguucacgcggaagguccgcagcaacgccgcgcugggcgccaucuucaccgacgagaacaaguggaaguccgcccgggaggccguggaggacagccgcuucugggagcucguggaccgggagcgcaaccugcaccuggaggggaagugcgagaccugcgucuacaacaugaugggcaagcgggagaagaagcucggggaguucggcaaggccaagggcucccgcgcgaucugguacauguggcugggggcccgguuccuggaguucgaggcccucggcuuccugaacgaggaccacugguucagccgcgggaacagccuguccggcguggagggggagggccuccacaagcugggcuacauccugcgggacgugagcaagaaggagggcggggccauguacgcggacgacaccgccgggugggacacgcgcaucacccucgaggaccugaagaacgaggagauggucaccaaccacaugaagggcgagcacaagaagcuggccgaggccaucuucaagcucaccuaccagaacaagguggugcggguccagcgcccgacgccccgcgggaccgugauggacaucaucucccggaaggaccagcgcggcagcggccagguggggaccuacggccugaacaccuucacgaacauggaggcccagcugauccggcagauggagggggagggcaucuucaaguccauccagcgccucaccgucaccgaggagaucgcggugcagaacuggcuggugcgggucggccgcgagcggcugagccgcauggccguguccggggacgacugcguggucaagccccucgacgaccgguucgccagcgcccugaccgcccugaacgacaugggcaaggugcgcaaggacauccagcagugggagcccucccggggguggaacgacuggacccaggugccguucugcagccaccacuuccacgagcucgucaugaaggacggccgcgugcuggugguccccugccggaaccaggacgagcugaucgggcgcgcgcggaucucccagggcgccggcuggagccucaaggagaccgccugccuggggaaguccuacgcccagauguggacccugauguacuuccaccgccgggaccuccgccuggccgcgaacgccaucugcagcgccgugcccucccacugggugcccaccagccggaccacgugguccauccacgccaagcacgaguggaugaccaccgaggacaugcuggccgucuggaaccgcguguggauccaggagaacccguggauggaggacaagacccccguggagagcugggaggagguccccuaccucggcaagcgcgaggaccaguggugcgggagccugaucggccugacgucccgggcgaccugggccaagaacauccagaccgccaucaaccaggugcgcagccucaucgggaacgaggaguacaccgacuacaugcccuccaugaagcgguuccgcaaggaggaggaggaggccggcgugcugugguga

SEQ ID NO: 9362 - RNA, 9876 nt, Artificial Sequence
  derived and/or modified CDS sequence (opt1) from DENV-2__EU529693__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaccauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacacgaucgugaucacgccccacagcggggaggagcacgccgucggcaacgacaccgggaagcacggcaaggagaucaagaucaccccgcaguccagcaucaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagacgaccaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggacgaugaagauccugaucggcgugaucaucaccuggaucgggaugaacagccgcuccaccagccuguccgucagccucgugcuggugggcaucgucacccuguaccucggggugauggugcaggccgacacgggcugcgucguguccuggaagaacaaggagcugaagugcggcagcgggaucuucaucaccgacaacgugcacaccuggaccgagcaguacaaguuccagcccgagucccccagcaagcuggcgagcgccauccagaaggcccacgaggagggcaucugcgggauccgguccgucacgcgccucgagaaccugauguggaagcagaucacccccgagcugaaccacauccucagcgagaacgaggugaagcugaccaucaugaccggcgacaucaaggggaucaugcaggccggcaagcggucccugcgcccgcagcccacggagcucaaguacagcuggaagaccuggggcaaggccaagaugcuguccaccgagagccacaaccagaccuuccugaucgacgggcccgagacggcggagugcccgaacaccaaccgggccuggaacucccucgagguggaggacuacggcuucggggucuucagcaccaacaucuggcugaagcugcgcgagaagcaggacguguucugcgacuccaagcucaugagcgccgccaucaaggacaaccgggccgugcacgcggacaugggcuacuggaucgaguccgcccugaacgacaccuggaagauggagaaggccagcuucaucgagaucaaguccugccacuggcccaagagccacacccugugguccaacggcguccucgagagcgagaugaucauccccaagaacuucgccgggcccgugucccagcacaacuaccgcccgggcuaccacacgcagaccgccgggcccuggcaccugggcaagcuggagauggacuucgacuucugcgaggggaccaccguggucgugacggaggacugcggcaaccggggccccagccuccgcaccaccaccgcgagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcgugggcacgaagcacgccauccuccuggucgcggugagcuucgugacccugaucaccgggaacauguccuuccgggaccucggccgcgucauggugauggugggggccaccaugacggacgacaucggcaugggcgucaccuaccuggcccugcucgccgccuucaaggugcgccccaccuucgcggccgggcugcugcuccggaagcugaccagcaaggagcugaugauggccacgaucggcaucgcccuccugucccagagcaccauccccgagaccauccuggagcucaccgacgcccuggcgcuggggaugauggugcucaagaucguccgcaacauggagaaguaccagcuggccgugacgaucauggccaucuccugcgugccgaacgccgucauccugcagaacgccuggaaggugagcugcaccauccucgcggccguguccgucagcccccugcugcucaccuccagccagcagaaggccgacuggaucccccuggcccugaccaucaagggccucaaccccacggcgaucuuccugaccacccugucccggaccagcaagaagcgcuccuggccgcucaacgaggccgugauggccgucggcauggugagcauccuggccuccagccugcucaagaacgacauccccaugacggggccccugguggccggcgggcugcucaccgucugcuacgugcugaccggccggagcgcggaccuggagcucgagcgcgccgccgacgugaagugggaggaccaggccgagaucuccgggagcucccccauccugagcaucaccaucuccgaggacggcagcauguccaucaagaacgaggaggaggagcacacgcugaccauccucauccggaccggccugcuggucaucagcgggguguucccgguguccauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacucccagaucggcgcggggguguacaaggagggcaccuuccacacgauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgccgugcagaccaagcccggccuguucaagaccaacacggggaccaucggcgcggugagccucgacuucucccccggcaccagcgggucccccaucgucgaccggaagggcaaggugguggggcuguacggcaacggcgucgugacccgcagcggggccuacguguccgccaucgcccagacggagaaguccaucgaggacaaccccgagaucgaggacgacaucuuccggaagaagcgccugaccaucauggaccuccaccccggcgcggggaagaccaagcgguaccugcccgccaucguccgcgaggccaucaagcggggccugcgcacccugauccucgccccgacgcgcgugguggccgcggagauggaggaggcccugcgggggcugcccauccgcuaccagacccccgccauccgggccgagcacaccggccgcgagaucgucgaccucaugugccacgccaccuucacgaugcggcugcugagccccgugcgcgugccgaacuacaaccucaucaucauggacgaggcgcacuucaccgaccccgccuccaucgccgcccggggcuacaucagcacccgcgucgagaugggggaggccgcgggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccugcgcaagaacggcaagaaggugauccagcugagccggaagaccuucgacuccgaguacgugaagacgcgcgccaacgacugggacuucgucgugaccaccgacaucagcgagaugggggccaacuuccgggccgagcgcgugaucgacccccggcgcugcaugaagcccgucauccucaccgacggcgaggagcgggugauccuggcggggcccaugccggugacgcacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggagguggagaucuggaccaaggagggcgagcgcaagaagcugaagccgcgguggcuggacgcccgcaucuacagcgacccccucgcccugaaggaguucaaggaguucgccgcgggccggaagucccugacgcucaaccugaucaccgagauggggcgccugcccaccuucaugacccagaaggcccgggacgcccucgacaaccuggccguccugcacacggccgaggugggcgggcgcgcguacaaccacgcccucagcgagcugcccgagacccuggagacccuccugcugcucacccugcuggccacggucaccggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucacguacguggucaucgccauccugaccgugguggccgccaccauggcgaacgagaugggguuccuggagaagaccaagaaggaccucggccugggcagcaucacgacccaggagagcgaguccaacauccuggacaucgaccuccgcccggccagcgccuggacccuguacgccgucgccaccacguucgugacccccaugcugcggcacuccaucgagaacagcuccgugaacgucagccucaccgcgaucgccaaccaggccaccgugcugauggggcugggccgcggguggccccucuccaagauggacaucggcgugccccugcuggccaucgggugcuacagccaggucaacccgaucacgcucaccgcggcccugcugcuccugguggcccacuacgccaucaucggccccggccugcaggccaaggcgacccgcgaggcccagaagcggaccgccgccgggaucaugaagaaccccacgguggacggcaucaccgucaucgaccucgagcccaucccguacgaccccaaguucgagaagcagcugggccaggugaugcugcucgugcugugcgucacccaggugcugaugaugcgcaccacgugggcccucugcgaggcgcugacccuggccaccggccccaucuccacccucugggaggggaaccccggccgguucuggaacacgaccaucgccgugagcauggccaacaucuuccgcggcuccuaccuggccggggcgggccuccucuucagcaucaugaagaacaccaccaacacgcggcgcgggaccggcaacaucggcgagacccugggggagaaguggaagucccggcugaacgcccucggcaagagcgaguuccagaucuacaagaaguccgggauccaggaggucgaccgcacccuggccaaggagggcaucaagcgcggggagacggaccaccacgccgugagccgcggcuccgcgaagcugcggugguucguggagcgcaacauggucaccccggagggcaaggugguggaccucgggugcggccgcggcggguggagcuacuacugcggcgggcugaagaacguccgcgaggugaaggggcugaccaagggcgggcccgggcacgaggagcccauccccauguccaccuacggcuggaaccucgugcggcugcagagcggggucgacguguucuucacgccgcccgagaagugcgacacccugcucugcgacaucggcgagagcucccccaaccccaccaucgaggccggccgcacccugcgggugcugaaccucgucgagaacuggcugaacaacaacacccaguucugcgugaaggugcugaacccguacaugcccagcgucaucgagaagauggagacgcuccagcgcaaguacgggggcgcccuggugcggaacccccugucccgcaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggucaacgggguggugaagcugcucaccaagcccugggacgucgugccgauggugacccagauggccaugacggacaccacccccuucggccagcagcgcgucuucaaggagaagguggacacccggacgcaggagcccaaggagggcaccaagaagcugaugcgcaucaccgccgaguggcuguggaaggagcucgggaagaagaagacgccccggaugugcacgcgcgaggaguucacccggaaggugcgcuccaacgccgcgcugggcgccaucuucaccgacgagaacaaguggaaguccgcccgggaggccgucgaggacucccgcuucugggagcugguggaccgggagcgcaaccuccaccuggaggggaagugcgagaccugcgucuacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacguguccaagaaggagggcggggccauguacgcggacgacacggccgggugggacacccgcaucacccuggaggaccucaagaacgaggagauggucaccaaccacaugaagggcgagcacaagaagcuggccgaggccaucuucaagcugacguaccagaacaagguggugcggguccagcgcccgacgccccgggggaccgugauggacaucaucagccggaaggaccagcgcggcuccggccagguggggaccuacggccucaacacguucaccaacauggaggcccagcugauccggcagauggagggggagggcaucuucaagagcauccagcgccugaccgucaccgaggagaucgcggugcagaacuggcucgcccgggugggccgcgagcggcugucccgcauggccaucagcggggacgacugcgucgugaagccccuggacgaccgguucgccuccgcccucacggcgcugaacgacaugggcaaggugcgcaaggacauccagcagugggagcccagccggggguggaacgacuggacccaggucccguucugcucccaccacuuccacgagcuggugaugaaggacggccgcaugcucgugguccccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccgugcccagccacugggugcccaccucccggacgaccuggagcauccacgccaagcacgaguggaugaccaccgaggacaugcuggcggucuggaaccgcguguggauccaggagaacccguggauggaggacaagacgcccguggaguccugggaggagguccccuaccugggcaagcgcgaggaccaguggugcgggagccucaucggccugaccagccgggccaccugggccaagaacauccagaccgccaucaaccaggugcgcucccugaucgggaacgaggaguacacggacuacaugcccagcaugaagcgguuccgcaaggaggaggaggaggcgggcgugcucugguga

SEQ ID NO: 9363 - RNA, 9876 nt, Artificial Sequence
  derived and/or modified CDS sequence (opt1) from DENV-2__EU482557__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcggaccgccgccgggaucaugaagaaccccaccguggacggcaucaccgugaucgaccucgagcccaucccguacgaccccaaguucgagaagcagcuggggcaggucaugcugcucgugcugugcgugacgcagguccugaugaugcgcaccaccugggcccucugcgaggcgcugacccuggccacgggccccaucagcacccucugggaggggaaccccggccgguucuggaacaccaccaucgccguguccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgucucccgcggcagcgcgaagcugcggugguucguggagcgcaacauggugaccccggagggcaaggucguggaccucgggugcggccgcggcgggugguccuacuacugcggcgggcugaagaacgugcgcgaggucaaggggcugacgaagggcgggcccgggcacgaggagcccauccccaugagcaccuacggcuggaaccucgugcggcugcagagcgggguggacgucuucuucaccccgcccgagaagugcgacacccugcucugcgacaucggcgaguccagccccaaccccacgaucgaggccggccgcacccugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccacggggaacaucguguccagcgugaacaugaucucccgcaugcugaucaaccgguucaccaugaagcacaagaaggccaccuacgagccggacgucgaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggugaacgggguggucaagcugcucacgaagcccugggacguggugccgauggucacccagauggccaugaccgacaccacgcccuucggccagcagcgcguguucaaggagaagguggacacccggacccaggagcccaaggagggcaccaagaagcugaugcgcaucacggccgaguggcuguggaaggagcucgggaagaagaagacgccccggaugugcacccgcgaggaguucacccggaagguccgcagcaacgccgcgcugggcgccaucuucacggacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggcgccauguacgcggacgacaccgccgggugggacacccgcaucacgcuggaggaccucaagaacgaggagauggugaccaaccacaugaagggcgagcacaagaagcuggccgaggccaucuucaagcugaccuaccagaacaaggugguccgggugcagcgcccgacgccccgggggacggugauggacaucaucucccggaaggaccagcgcggcagcggccaggucgggaccuacggccucaacaccuucaccaacauggaggcccagcugauccggcagauggagggggagggcaucuucaaguccauccagcgccugacggugaccgaggagaucgcggugcagaacuggcucgcccgggucggccgcgagcggcugagccgcauggccaucuccggggacgacugcguggugaagccccuggacgaccgguucgccagcgcccucaccgcgcugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccguccccucccacugggugcccaccagccggaccaccugguccauccacgccaagcacgaguggaugacgaccgaggacaugcuggcgguguggaaccgcgucuggauccaggagaacccguggauggaggacaagacccccguggagagcugggaggaggugcccuaccugggcaagcgcgaggaccaguggugcgggagccucaucggccugaccucccgggccacgugggccaagaacauccagaccgccaucaaccagguccgcagccugaucgggaacgaggaguacaccgacuacaugcccuccaugaagcgguuccgcaaggaggaggaggaggcgggcgugcucugguga

SEQ ID NO: 9364 - RNA, 9876 nt, Artificial Sequence
  derived and/or modified CDS sequence (opt1) from DENV-2__EU482560__SS-prME
accgccggcgucaucgucaugcugauccccaccgugauggccuuccaccucaccacccgcaacggggagccccacaugaucgugggccggcaggagaaggggaagucccugcuguucaagaccgaggacggcaucaacaugugcacccucauggcgaucgaccugggggagcugugcgaggacaccaucaccuacaagugcccccuccugaagcagaacgagcccgaggacaucgacugcuggugcaacagcaccagcaccugggucaccuacgggaccugcaccaccacgggcgagcaccgccgggagaagcgcuccguggcccuggugccccacgucgggaugggccucgagacccggaccgagaccuggaugagcuccgagggggccuggaagcacgugcagcgcaucgagacguggauccugcggcacccgggcuucaccaucauggccgccauccuggcguacaccaucgggaccacgcacuuccagcgcgcccucaucuucauccugcugaccgccguggcccccagcaugaccaugcggugcaucggcaucuccaaccgcgacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccaugguggaccgcggcugggggaacggcugcgggcuguucggcaagggcgggaucgugaccugcgccauguucacgugcaagaagaacauggagggcaagguggugcagcccgagaaccuggaguacaccaucgucaucacgccccacagcggggaggagcacgcggugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgccaagaagcaggacgucgugguccucgggucccaggagggcgcgaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggccgagccgcccuucggcgacuccuacaucaucaucgggguggagccgggccagcugaagcucaacugguucaagaaggggagcuccaucggccagauguucgagacgaccaugcgcggcgcgaagcgcauggccauccugggggacaccgccugggacuucggcagccucgggggcgucuucaccuccaucgggaaggcccuccaccagguguucggcgccaucuacggcgcggccuucagcgggguguccuggacgaugaagauccugaucggcgucaucaucaccuggaucgggaugaacagccgguccaccagccuguccgugagccuggugcucgucggcguggugacccuguaccugggggccaugguccaggccgacuccggcugcguggugagcuggaagaacaaggagcucaagugcggcuccgggaucuucaucacggacaacguccacaccuggaccgagcaguacaaguuccagcccgagagccccagcaagcuggcguccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggccaagaugcucagcaccgagucccacaaccagaccuuccugaucgacgggcccgagaccgcggagugcccgaacacgaaccgcgccuggaacagccuggaggucgaggacuacggcuucgggguguucaccaccaacaucuggcucaagcugcgggagaagcaggacgccuucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaaccaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacccgggucggcacgaagcacgcgauccugcucguggccgugagccuggucacccugaucaccgggaacauguccuuccgcgaccucggccgggugauggugauggucggggccaccaugacggacgacaucggcaugggcgugaccuaccuggcccugcucgccgcguucaaggugcgccccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcuuccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgagaacaaccccgagaucgaggacgacaucuuccgcaagaagcggcugaccaucauggaccuccaccccggggccggcaagaccaagcgcuaccugcccgccaucguccgggaggccaucaagcgcgggcugcggacccugauccucgccccgacgcgcgugguggcggccgagauggaggaggcccugcgcggccugcccauccgguaccagacccccgccauccgcgccgagcacaccgggcgggagaucgucgaccucaugugccacgcgaccuucacgaugcgccugcugagccccgugcgggugccgaacuacaaccucaucaucauggacgaggcccacuucaccgaccccgccuccaucgccgcccgcggcuacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccugcggaagaacggcaagaaggugauccagcugagccgcaagaccuucgacuccgaguacgugaagacgcgggccaacgacugggacuucgucgugaccaccgacaucagcgagaugggcgccaacuucaaggcggagcgcgugaucgacccccggcgcugcaugaagcccgucauccucaccgacggggaggagcgggugauccuggccggccccaugccggugacgcacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuacaaggucgccgcggaggggaucaacuacgccgaccggaaguggugcuucgacggcaucaagaacaaccagauccucgaggagaacguggagguggagaucuggaccaaggagggggagcgcaagaagcugaagccgcgguggcuggacgcccgcaucuacagcgacccccucgcccugaaggaguucaaggaguucgcggccggccggaagucccugacgcucaaccugaucaccgagaugggccgccugcccaccuucaugacccagaaggcccggaacgcccucgacaaccuggccguccugcacacggcggaggccgggggccgcgccuacaaccacgcccucagcgagcugcccgagacccuggagacccuccugcugcucacccugcuggccacggugaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucacguacguggugaucgccauccugaccgucguggcggccaccauggccaacgagaugggcuuccuggagaagaccaagaaggaccucgggcugggcagcaucacgacccaggagagcgaguccaacauccuggacaucgaccuccgcccggccagcgccuggacccuguacgcgguggccaccacguucgucacccccaugcugcggcacuccaucgagaacagcuccgugaacgugagccucaccgccaucgccaaccaggcgaccguccugaugggccuggggaagggcuggccccucuccaagauggacaucggggugccccugcuggccaucggcugcuacagccaggugaacccgaucacgcucaccgccgcccugcugcuccuggucgcccacuacgcgaucaucgggcccggccugcaggccaaggccacccgcgaggcccagaagcgggccgcggccggcaucaugaagaaccccaccguggacgggaucacggugaucgaccucgagcccaucccguacgaccccaaguucgagaagcagcugggccaggucaugcugcucauccugugcgugacccaggugcugaugaugcgcaccaccugggcccucugcgaggcccugacgcuggccaccgggcccaucuccacccucugggagggcaaccccgggcgguucuggaacaccacgaucgcggucagcauggccaacaucuuccgcggcuccuaccuggccggcgccgggcuccuguucagcaucaugaagaacaccaccaacacccgccggggcacggggaacaucggcgagacccugggcgagaaguggaagucccgccugaacgcgcucggcaagagcgaguuccagaucuacaagaaguccggcauccaggagguggaccggacccuggccaaggaggggaucaagcgcggcgagaccgaccaccacgccgugagccggggguccgccaagcugcgcugguucgucgagcggaacauggugacgccggagggcaagguggucgaccucggcugcgggcgcggcggguggagcuacuacugcggcgggcugaagaacgugcgggaggugaagggccugaccaagggcgggcccggccacgaggagcccauccccauguccaccuacggguggaaccucguccgccugcagagcggcguggacguguucuucaccccgcccgagaagugcgacacgcugcucugcgacaucggggagagcucccccaaccccaccaucgaggccggccggacccugcgcguccugaaccucguggagaacuggcugaacaacaacacccaguucugcaucaaggugcugaacccguacaugcccagcgucaucgagaagauggagacccuccagcggaaguacggcggggcgcuggugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagccggacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggucaacggcguggugcgccugcucaccaagcccugggacgucgugccgauggugacccagauggcgaugaccgacacgacccccuucgggcagcagcgcgucuucaaggagaagguggacacccggacccaggagcccaaggagggcacgaagaagcugaugaagaucaccgccgaguggcuguggaaggagcucggcaagaagaagacgccccgggugugcacccgggaggaguucacgcgcaagguccggagcaacgccgcccugggggccaucuucaccgacgagaacaaguggaaguccgcgcgcgaggccguggaggacggccgguucugggagcugguggaccgcgagcggaaccuccaccuggaggggaagugcgagaccugcgucuacaacaugaugggcaagcgcgagaagaagcugggggaguucggcaaggccaagggcagccgggccaucugguacauguggcucggggcgcgcuuccuggaguucgaggcccugggcuuccucaacgaggaccacugguucucccgggggaacagccugagcggcguggagggggagggccugcaccgccucggcuacauccugcgggacgucgggaagaaggagggcggggccauguacgccgacgacaccgccggcugggacacgcgcaucacccuggaggaccucaagaacgaggagauggugaccaaccacaugaagggggagcacaagaagcuggcggaggccaucuucaagcugaccuaccagaacaaggugguccgggugcagcgcccgacgccccggggcaccgugauggacaucaucucccgccgggaccagcgcggcagcgggcaggucggcaccuacgggcucaacaccuucacgaacauggaggcccagcugauccgccagauggagggcgagggcaucuucaaguccauccagcaccugaccgccaccgaggagaucgccgugcagaacuggcucgcgcggguggggcgcgagcggcugagccgcauggccaucuccggcgacgacugcgucgugaagcccaucgacgaccgguucgccagcgcccugaccgcccucaacgacauggggaaggugcgcaaggacauccagcagugggagcccucccggggcuggaacgacuggacgcaggucccguucugcagccaccacuuccacgagcuggugaugaaggacgggcgcgugcuggucgugcccugccggaaccaggacgagcucaucggccgcgcgcggaucucccagggcgccggguggagccugaaggagaccgccugccugggcaaguccuacgcccagauguggacccucauguacuuccaccgccgggaccugcgccuggccgcgaacgccaucugcagcgccgugcccucccacuggguccccaccagccggaccacgugguccauccacgccaagcacgaguggaugaccaccgaggacaugcucgcgguguggaaccgcguguggauccaggagaacccguggauggaggacaagacccccgucgagagcugggaggaggugcccuaccuggggaagcgggaggaccaguggugcggcucccugaucgggcucacgagccgcgccaccugggccaagaacauccagaccgccaucagccaggugcggucccugaucggcaacgaggaguacaccgacuacaugcccagcaugaagcgcuuccgccgggaggaggaggaggccggcguccugugguga

SEQ ID NO: 9365 - RNA, 9876 nt, Artificial Sequence
  derived and/or modified CDS sequence (opt1) from DENV-2__EU482561__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggucguguccuucgugacccugaucacggggaacaugagcuuccgggaccucggccgcgucauggugauggugggggccaccaugaccgacgacaucggcaugggcaucaccuaccuggcccugcucgccgcguucaagguccgccccacguucgccgccgggcugcugcuccggaagcugaccuccaaggagcugaugauggccaccaucggcaucgcccuccugagccaguccaccauccccgagacgauccuggagcucaccgacgcgcuggcccuggggaugauggugcucaagaucgugcgcaacauggagaaguaccagcuggccgucaccaucauggccaucagcugcgugccgaacgccgugauccugcagaacgcguggaaggucuccugcaccauccucgccgccgugagcgucagcccccugcugcucacgagcucccagcagaaggccgacuggaucccccuggcgcugaccaucaagggccucaaccccaccgccaucuuccugaccacgcugagccggaccuccaagaagcgcagcuggccgcucaacgaggccaucauggccgugggcaugguguccauccuggccagcagccugcucaagaacgacauccccaugaccgggccccuggucgcgggcgggcugcucaccgugugcuacgugcugacgggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacagccagaucggcgccgggguguacaaggagggcaccuuccacaccauguggcacgucacccgcggggcggugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagacgaagcccggccucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucucccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagacguucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcgacgcccuggacaaccuggccgugcuccacaccgcggaggccggcgggcgggccuacaaccacgcccuguccgagcugcccgagacccucgagacgcugcugcuccugacccugcucgccaccgucaccggcggcaucuuccuguuccugaugagcgggaagggcaucgggaagaugacgcucggcaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugaccgugguggcggccacgauggccaacgagaugggguuccucgagaagaccaagaaggaccugggccugggcagcaucgccacccaggaguccgagagcaacauccucgacaucgaccugcggccggccuccgcguggacccuguacgccgucgccacgaccuucgugacccccaugcuccgccacagcaucgagaacuccagcgugaacgucucccugaccgccaucgcgaaccaggccacggugcugauggggcucggcaagggguggccccugagcaagauggacaucggcgugccccugcucgccaucgggugcuacucccaggucaacccgaucacccugaccgccgcccugcuccugcugguggcgcacuacgccaucaucggccccggccuccaggccaaggccacccgggaggcccagaagcgcgcggccgccgggaucaugaagaaccccacgguggacggcaucaccgucaucgaccuggagcccaucccguacgaccccaaguucgagaagcagcuggggcaggucaugcuccugauccugugcgugacccagguccucaugaugcgcaccacgugggcccugugcgaggcccugacccucgcgaccggccccaucagcacccugugggaggggaaccccggccgguucuggaacacgaccaucgccguguccauggccaacaucuuccgcggcagcuaccuggccggggcgggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggccaaggagggcaucaagcgcggggagacggaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcaccuacggcuggaaccuggugcggcugcagagcgggguggacgucuucuucacgccgcccgagaagugcgacacccuccugugcgacaucggcgaguccagccccaaccccaccaucgaggcgggccgcacccugcgggugcucaaccugguggagaacuggcugaacaacaacacgcaguucugcaucaagguccucaacccguacaugcccuccgugaucgagaagauggagacccugcagcgcaaguacgggggcgcccuggugcggaacccccugagccgcaacuccacccacgagauguacugggucagcaacgccaccgggaacaucguguccagcgugaacaugaucucccggaugcucaucaaccgcuucaccaugaagcacaagaaggccacguacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggugaacggggugguccgccuccugaccaagcccugggacguggugccgauggucacccagauggccaugacggacaccacccccuucggccagcagcggguguucaaggagaagguggacacccgcacgcaggagcccaaggagggcaccaagaagcugaugaagaucaccgccgaguggcucuggaaggagcuggggaagaagaagacgccccggaugugcacgcgcgaggaguucacccggaagguccgcuccaacgccgcccugggcgcgaucuucaccgacgagaacaaguggaaguccgcccgggaggccguggaggacucccgcuucugggagcucaucgaccgggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgccgacgacacggcggggugggacacccggaucacccucgaggaccugaagaacgaggagauggucaccaaccacaugaagggcgagcacaagaagcuggccgaggccaucuucaagcucacguaccagaacaagguggugcgcguccagcggccgacgccccgggggaccgugauggacaucaucagccgccgggaccagcgcggcuccggccagguggggaccuacggccugaacacguucaccaacauggaggcccagcugauccggcagauggagggggagggcaucuucaagagcauccagcaccucaccgucaccgaggagaucgccgugcagaacuggcuggcgcgcgugggccgggagcgccugucccggauggccaucagcggggacgacugcgucgugaagccccucgacgaccgcuucgccuccgcccugacggcccugaacgacaugggcaaggugcggaaggacauccagcagugggagcccagccgcggguggaacgacuggacccaggucccguucugcucccaccacuuccacgagcucaucaugaaggacggccgggugcuggugguccccugccgcaaccaggacgagcugaucgggcgggcgcgcaucagccagggcgccggcuggucccucaaggagaccgccugccugggcaagagcuacgcccagauguggacccugauguacuuccaccggcgcgaccuccggcuggccgcgaacgccaucugcuccgccgugcccagccacugggugcccacgucccgcaccaccuggagcauccacgccaagcacgaguggaugaccaccgaggacaugcuggcggucuggaaccggguguggauccaggagaacccguggauggaggacaagacgcccguggagagcugggaggagguccccuaccucggcaagcgcgaggaccaguggugcgggucccugaucggccugaccagccgcgccaccugggccaagaacauccagaccgccaucaaccaggugcggucccucaucgggaacgaggaguacacggacuacaugcccagcaugaagcgcuuccggcgcgaggaggaggaggccggcgugcugugguga

SEQ ID NO: 9366 - RNA, 9876 nt, Artificial Sequence
  derived and/or modified CDS sequence (opt1) from DENV-2__EU569703__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggugguccgccugcucaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcuguggaaggagcucgggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagacgugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggcgcgauguacgccgacgacaccgccgggugggacacccggaucacccuggaggaccucaagaacgaggagauggugacgaaccacaugaagggcgagcacaagaagcuggccgaggccaucuucaagcugaccuaccagaacaaggugguccgcgugcagcgcccgacgccccgggggaccgugauggacaucaucucccgcaaggaccagcggggcagcggccaggucgggacguacggccucaacaccuucaccaacauggaggcgcagcugauccgccagauggagggggagggcaucuucaaguccauccagcggcugaccgugacggaggagaucgccgugcagaacuggcucgcccgcgucggccgggagcgccugagccggauggccaucuccggggacgacugcguggugaagccccuggacgaccgcuucgccagcgcgcucaccgcccugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagaccgccugccucgggaaguccuacgcgcagauguggacgcugauguacuuccaccggcgcgaccugcggcucgccgccaacgccaucugcagcgccguccccucccacugggugcccaccagccgcaccaccugguccauccacgcgaagcacgaguggaugaccacggaggacaugcuggccguguggaaccgcgucuggauccaggagaacccguggauggaggacaagacccccguggagagcugggaggaggugcccuaccugggcaagcgggaggaccaguggugcgggagccucaucggccugaccucccgcgccaccugggccaagaacauccagacggcgaucaaccagguccggagccugaucgggaacgaggaguacaccgacuacaugcccuccaugaagcgcuuccggaaggaggaggaggaggccggcgugcucugguga

SEQ ID NO: 9367 - RNA, 9876 nt, Artificial Sequence
  derived and/or modified CDS sequence (opt1) from DENV-2__EU529694__SS-prME
accgccggcgucuucaucaugcugauccccaccgccauggcguuccaccucaccacccggaacggggagccccacaugaucgucggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggccgucuccuucgugacccugaucacggggaacaugagcuuccgggaccucggccgcgugauggucauggugggggccaccaugaccgacgacaucggcaugggcaucaccuaccuggcccugcucgcggccuucaaggugcgccccacguucgccgccgggcugcugcuccggaagcugaccuccaaggagcugaugauggccaccaucggcaucgcgcuccugagccaguccaccauccccgagacgauccuggagcucaccgacgcccuggcccuggggaugaugguccucaagaucgugcgcaacauggagaaguaccagcuggccgugaccaucauggccaucagcugcgucccgaacgcggugauccugcagaacgccuggaagguguccugcaccauccucgccgccgucagcgugagcccccugcugcucacgagcucccagcagaaggcggacuggaucccccuggcccugaccaucaagggccucaaccccaccgccaucuuccugaccacgcugagccggaccuccaagaagcgcagcuggccgcucaacgaggccaucauggccgucggcaugguguccauccuggcgagcagccugcucaagaacgacauccccaugaccgggccccugguggccggcgggcugcucaccgucugcuacgugcugacgggccgguccgccgaccuggagcucgagcgcgccgccgacgugaagugggaggaccaggcggagaucagcggguccagccccauccuguccaucaccaucagcgaggacggcuccaugagcaucaagaacgaggaggaggagcagacccugaccauccucauccggacgggccugcuggucaucuccgggguguucccggugagcauccccaucaccgccgccgccugguaccucugggaggucaagaagcagcgcgccggcgugcugugggacgugcccagcccgccgcccgucgggaaggcggagcuggaggacggcgccuaccggaucaagcagcgcgggauccucggcuacagccagaucggcgccgggguguacaaggagggcaccuuccacaccauguggcacgugacccgcggggcgguccugaugcaccgcggcaagcggaucgagcccuccugggccgacgugaagaaggaccugaucagcuacgggggcggcuggaagcucgagggggaguggaaggagggcgaggaggugcagguccuggcgcuggagcccgggaagaacccccgcgccgugcagacgaagcccggccucuucaagaccaacaccgggaccaucggcgccgugucccuggacuucagccccggcacguccgggagccccaucgucgaccggaagggcaaggugguggggcuguacggcaacggcgucgugacccgcuccggggccuacgugagcgcgaucgcccagaccgagaaguccaucgaggacaaccccgagaucgaggacgacaucuuccggaagaagcgccucaccaucauggaccugcaccccggcgccgggaagacgaagcgguaccugcccgccaucguccgcgaggccaucaagcggggccugcgcacccucauccuggcgccgacccgcgugguggccgccgagauggaggaggcccugcgggggcuccccauccgcuaccagacccccgccauccgggcggagcacacgggccgcgagaucgucgaccugaugugccacgccaccuucaccaugcggcugcucucccccgugcgcgugccgaacuacaaccugaucaucauggacgaggcccacuucaccgaccccgccagcaucgccgcgcggggcuacaucuccacgcgcgucgagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagacggugugguucgucccgagcaucaaggccggcaacgacaucgccgccugccugcgcaagaacggcaagaaggugauccagcucucccggaagaccuucgacagcgaguacgugaagacccgcgccaacgacugggacuucgucgugaccacggacaucuccgagaugggggcgaacuucaaggccgagcgggugaucgacccccgccggugcaugaagcccgucauccugaccgacggcgaggagcgcgugauccuggccgggcccaugccggugacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaaggucgacgccaucgacggggaguaccggcuccgcggcgaggcccggaagacguucguggaccugaugcgccgcggggaccugcccguguggcucgccuaccgcgucgcggccgagggcaucaacuacgccgaccggcgcuggugcuucgacgggaucaagaacaaccagauccuggaggagaacguggagguggagaucuggaccaaggagggcgagcggaagaagcugaagccgcgcuggcucgacgcccggaucuacuccgacccccuggcgcugaaggaguucaaggaguucgccgccggccgcaagagccucacccugaaccugaucaccgagauggggcggcuccccacguucaugacccagaaggcccgcgacgcccuggacaaccuggcgguccuccacaccgccgaggccggcgggcgggccuacaaccacgcccuguccgagcugcccgagacccucgagacgcugcugcuccugacccugcucgcgaccgugaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccacgauggccaacgagaugggguuccucgagaagaccaagaaggaccugggccugggcagcaucgccacccaggaguccgagagcaacauccucgacaucgaccugcggccggcguccgccuggacccuguacgccguggccacgaccuucgucacccccaugcuccgccacagcaucgagaacuccagcgugaacgugucccugaccgcgaucgccaaccaggccacgguccugauggggcucggcaagggguggccccugagcaagauggacaucggcgugccccugcucgccaucgggugcuacucccaggugaacccgaucacccugaccgccgcgcugcuccugcuggucgcccacuacgccaucaucggccccggccuccaggccaaggccacccgggaggcgcagaagcgcgccgccgccgggaucaugaagaaccccacgguggacggcaucaccgugaucgaccuggagcccaucccguacgaccccaaguucgagaagcagcuggggcaggucaugcuccugauccugugcgugacccaggugcucaugaugcgcaccacgugggcccugugcgaggcgcugacccucgccaccggccccaucagcacccugugggaggggaaccccggccgguucuggaacacgaccaucgccgucuccauggccaacaucuuccgcggcagcuaccuggcgggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggccaaggagggcaucaagcgcggggagacggaccaccacgccgugucccgcggcagcgcgaagcuccggugguucgucgagcgcaacauggugaccccggagggcaagguggucgaccuggggugcggccgcggcgggugguccuacuacugcggcgggcugaagaacgugcgcgaggugaaggggcucaccaagggcgggcccgggcacgaggagcccauccccaugagcaccuacggcuggaaccugguccggcugcagagcgggguggacguguucuucacgccgcccgagaagugcgacacccuccugugcgacaucggcgaguccagccccaaccccaccaucgaggccggccgcacccugcggguccucaaccugguggagaacuggcugaacaacaacacgcaguucugcaucaaggugcucaacccguacaugcccuccgucaucgagaagauggagacccugcagcgcaaguacgggggcgcccuggugcggaacccccugagccgcaacuccacccacgagauguacugggugagcaacgccaccgggaacaucgucuccagcgugaacaugaucucccggaugcucaucaaccgcuucaccaugaagcacaagaaggccacguacgagccggacguggaccugggcagcgggacccgcaacaucggcaucgaguccgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggucaacgggguggugcgccuccugaccaagcccugggacgucgugccgauggugacccagauggccaugacggacaccacccccuucggccagcagcgggucuucaaggagaagguggacacccgcacgcaggagcccaaggagggcaccaagaagcugaugaagaucaccgccgaguggcucuggaaggagcuggggaagaagaagacgccccggaugugcacgcgcgaggaguucacccggaaggugcgcuccaacgccgcgcugggcgccaucuucaccgacgagaacaaguggaaguccgcccgggaggccgucgaggacucccgcuucugggagcucaucgaccgggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucagccgcgggaacucccugagcggcguggagggggagggccuccaccggcugggcuacauccugcgcgacgucuccaagaaggagggcggggccauguacgcggacgacacggccgggugggacacccggaucacccucgaggaccugaagaacgaggagauggugaccaaccacaugaagggcgagcacaagaagcuggccgaggccaucuucaagcucacguaccagaacaaggucgugcgcgugcagcggccgacgccccgggggaccgucauggacaucaucagccgccgggaccagcgcggcuccggccagguggggaccuacggccugaacacguucaccaacauggaggcccagcugauccggcagauggagggggagggcaucuucaagagcauccagcaccucaccgugaccgaggagaucgcgguccagaacuggcuggcccgcgugggccgggagcgccugucccggauggccaucagcggggacgacugcguggucaagccccucgacgaccgcuucgccuccgcccugacggcgcugaacgacaugggcaaggugcggaaggacauccagcagugggagcccagccgcggguggaacgacuggacccaggugccguucugcucccaccacuuccacgagcucgucaugaaggacggccgggugcuggugguccccugccgcaaccaggacgagcugaucgggcgggcccgcaucagccagggcgccggcuggucccucaaggagaccgccugccugggcaagagcuacgcccagauguggacccugauguacuuccaccggcgcgaccuccggcuggcggccaacgccaucugcuccgccgugcccagccacugggugcccacgucccgcaccaccuggagcauccacgcgaagcacgaguggaugaccaccgaggacaugcuggccgucuggaaccggguguggauccaggagaacccguggauggaggacaagacgcccguggagagcugggaggagguccccuaccucggcaagcgcgaggaccaguggugcgggucccugaucggccugaccagccgcgccaccugggccaagaacauccagaccgccaucaaccaggugcggucccucaucgggaacgaggaguacacggacuacaugcccagcaugaagcgcuuccggcgcgaggaggaggaggcgggcgugcugugguga

SEQ ID NO: 9368 - RNA, 9876 nt, Artificial Sequence
  derived and/or modified CDS sequence (opt1) from DENV-2__EU529695__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaucacccaggaguccgagagcaacauccuggacaucgaccuccgcccggccuccgccuggacccuguacgccguggccacgaccuucgucacccccaugcugcggcacagcaucgagaacuccagcgugaacgugucccucaccgcgaucgccaaccaggccacgguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacccgcgaggcccagaagcgggccgccgccgggaucaugaagaaccccacgguggacggcaucaccgugaucgaccucgagcccaucccguacgaccccaaguucgagaagcagcuggggcaggucaugcugcucgugcugugcgugacccagguccugaugaugcgcaccacgugggcgcucugcgaggcccugacccuggccaccggccccaucagcacccucugggaggggaaccccggccgguucuggaacacgaccaucgccguguccauggccaacaucuuccgcggcagcuaccuggcgggggccggccuccucuucuccaucaugaagaacaccaccaacacgcggcgcgggaccggcaacaucggcgagacccugggggagaaguggaagucccggcugaacgcccucggcaaguccgaguuccagaucuacaagaaguccgggauccaggagguggaccgcacccuggccaaggagggcaucaagcgcggggagacggaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcaccuacggcuggaaccucgugcggcugcagagcgggguggacgucuucuucacgccgcccgagaagugcgacacccugcucugcgacaucggcgaguccagccccaaccccaccaucgaggccggccgcacccugcgggugcugaaccucguggagaacuggcugaacaacaacacgcaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucaccaugaagcacaagaaggcgacguacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcucaccaagcccugggacguggugccgauggucacccagauggccaugacggacaccacccccuucggccagcagcggguguucaaggagaagguggacacccgcacgcaggagcccaaggagggcaccaagaagcugaugcggaucaccgccgaguggcuguggaaggagcucgggaagaagaagacgccccggaugugcacgcgggaggaguucacccgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggcgcgauguacgccgacgacacggccgggugggacacccggaucacccuggaggaccucaagaacgaggagauggugaccaaccacaugaagggcgagcacaagaagcuggccgaggccaucuucaagcugacguaccagaacaaggugguccgcgugcagcgcccgacgccccgggggaccgugauggacaucaucucccgcaaggaccagcggggcagcggccaggucgggaccuacggccucaacacguucaccaacauggaggcgcagcugauccgccagauggagggggagggcaucuucaaguccauccagcaccugaccgugaccgaggagaucgccgugcagaacuggcucgcccgggucggccgcgagcggcugagccgcauggccaucuccggggacgacugcguggugaagccccuggacgaccgguucgccagcgcgcucacggcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagaccgccugccucgggaaguccuacgcgcagauguggacccugauguacuuccaccgccgggaccugcgccucgccgccaacgccaucugcagcgccguccccucccacugggugcccacgagccggaccaccugguccauccacgcgaagcacgaguggaugaccaccgaggacaugcuggccguguggaaccgcgucuggauccaggagaacccguggauggaggacaagacgcccguggagagcugggaggaggugcccuaccugggcaagcgcgaggaccaguggugcgggagccucaucggccugaccucccgggccaccugggccaagaacauccagaccgcgaucaaccagguccgcagccugaucgggaacgaggaguacacggacuacaugcccuccaugaagcgguuccgcaaggaggaggaggaggccggcgugcucugguga

SEQ ID NO: 9369 - RNA, 9876 nt, Artificial Sequence
  derived and/or modified CDS sequence (opt1) from DENV-2__EU482562__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugauccuguaccucggggccaugguccaggcggacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggccggcaagcggucccugcgcccgcagcccaccgagcucaaguacagcuggaagaccuggggcaaggcgaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgcggggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgcgauccuccugguggccgucuccuucgugacccugaucacggggaacaugagcuuccgggaccucggccgcgugauggucauggugggggccaccaugaccgacgacaucggcaugggcgugaccuaccuggcccugcucgccgcguucaagguccgccccacguucgccgccgggcugcugcuccggaagcugaccuccaaggagcugaugauggccaccaucggcaucgcccuccugagccaguccaccauccccgagacgauccuggagcucaccgacgcgcuggcccuggggaugauggugcucaagaucgugcgcaacauggagaaguaccagcuggccgucaccaucauggccaucagcugcgugccgaacgccgugauccugcagaacgcguggaaggucuccugcaccauccucgccgccgugagcgucagcccccugcugcucacgagcucccagcagaaggccgacuggaucccccuggcgcugaccaucaagggccucaaccccaccgccaucuuccugaccacgcugagccggaccuccaagaagcgcagcuggccgcucaacgaggccaucauggccgugggcaugguguccauccuggccagcagccugcucaagaacgacauccccaugaccgggccccuggucgcgggcgggcugcucaccgugugcuacgugcugacgggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacagccagaucggcgccgggguguacaaggagggcaccuuccacaccauguggcacgucacccgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagacgaagcccggccucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucucccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagacguucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcgacgcccuggacaaccuggccgugcuccacaccgcggaggccggcgggcgggccuacaaccacgcccuguccgagcugcccgagacccucgagacgcugcugcuccugacccugcucgccaccgucaccggcggcaucuuccuguuccugaugagcgggaagggcaucgggaagaugacgcucggcaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugaccgugguggcggccacgauggccaacgagaugggguuccucgagaagaccaagaaggaccugggccugggcagcaucaccacccaggaguccgagagcaacauccucgacaucgaccugcggccggccuccgccuggacgcuguacgcggucgccaccaccuucgugacccccaugcuccgccacagcaucgagaacuccagcgugaacgucucccugacggccaucgccaaccaggcgaccgugcugauggggcucggcaagggguggccccugagcaagauggacaucggcgugccccugcucgccaucgggugcuacucccaggucaacccgaucacccugaccgccgcccugcuccugcugguggcccacuacgcgaucaucggccccggccuccaggccaaggccacgcgggaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacccagguccucaugaugcgcacgaccugggcccugugcgaggcccugacccucgccaccggccccaucagcacgcugugggaggggaaccccggccgguucuggaacaccaccaucgcgguguccauggccaacaucuuccgcggcagcuaccuggccggggccggccuccuguucuccaucaugaagaacaccacgaacacccggcgcgggaccggcaacaucggcgagacccugggggagaaguggaagucccggcucaacgcgcugggcaaguccgaguuccagaucuacaagaaguccgggauccaggagguggaccgcacgcuggccaaggagggcaucaagcgcggggagaccgaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcacguacggcuggaaccuggugcggcugcagagcgggguggacgucuucuucaccccgcccgagaagugcgacacccuccugugcgacaucggcgaguccagccccaaccccaccaucgaggccggccgcacgcugcgggugcucaaccugguggagaacuggcugaacaacaacacccaguucugcaucaagguccucaacccguacaugcccuccgugaucgagaagauggagacccugcagcgcaaguacgggggcgcgcuggugcggaacccccugagccgcaacuccacccacgagauguacugggucagcaacgccaccgggaacaucguguccagcgugaacaugaucucccggaugcucaucaaccgcuucacgaugaagcacaagaaggccaccuacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgccuccuucauggugaacggggugguccgccuccugaccaagcccugggacguggugccgauggucacgcagauggcgaugaccgacaccacccccuucggccagcagcggguguucaaggagaagguggacacgcgcacccaggagcccaaggagggcaccaagaagcugaugaagaucaccgccgaguggcucuggaaggagcuggggaagaagaagacgccccggaugugcacccgcgaggaguucacccggaagguccgcagcaacgccgcccugggcgccaucuucaccgacgagaacaaguggaaguccgcgcgggaggccguggaggacagccgcuucugggagcucaucgaccgggagcgcaaccugcaccuggaggggaagugcgagacgugcguguacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgggaacagccuguccggcgucgagggggagggccuccaccggcugggcuacauccugcgcgacgugagcaagaaggagggcggcgccauguacgccgacgacaccgccgggugggacacccggaucacccucgaggaccugaagaacgaggagauggucacgaaccacaugaagggcgagcacaagaagcuggcggaggccaucuucaagcucaccuaccagaacaagguggugcgcguccagcggccgacgccccgggggaccgugauggacaucaucucccgccgggaccagcgcggcagcggccagguggggacguacggccugaacaccuucaccaacauggaggcccagcugauccggcagauggagggggagggcaucuucaaguccauccagcaccucaccgucacggaggagaucgccgugcagaacuggcuggcccgcgugggccgggagcgccugagccggauggcgaucuccggggacgacugcgucgugaagccccucgacgaccgcuucgccagcgcccugaccgcccugaacgacaugggcaaggugcggaaggacauccagcagugggagcccucccgcggguggaacgacuggacccaggucccguucugcagccaccacuuccacgagcucgugaugaaggacggccgggugcuggucgugcccugccgcaaccaggacgagcugaucgggcgggcccgcaucucccagggcgcgggcuggagccucaaggagaccgccugccuggggaaguccuacgcccagauguggacgcugauguacuuccaccggcgcgaccuccggcuggccgccaacgcgaucugcagcgccgugcccucccacuggguccccaccagccgcaccaccugguccauccacgccaagcacgaguggaugaccacggaggacaugcuggccguguggaaccggguguggauccaggagaacccguggauggaggacaagacccccgucgagagcugggaggaggugcccuaccucggcaagcgcgaggaccaguggugcgggagccugaucggccugaccucccgcgcgaccugggccaagaacauccagacggccaucaaccaggugcggagccucaucgggaacgaggaguacaccgacuacaugcccuccaugaagcgcuuccggcgcgaggaggaggaggccggcguccugugguga

SEQ ID NO: 9370 - RNA, 9876 nt, Artificial Sequence
  derived and/or modified CDS sequence (opt1) from DENV-2__EU482565__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacauccuggggcgccugaucaccgucaacccgaucgugaccgagaaggacagccccgugaacaucgaggcggagccgcccuucggcgacuccuacaucaucaucggggucgagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccagguguucggcgcgaucuacggcgccgccuucagcggggucuccuggaccaugaagauccugaucggcgugaucaucacguggaucgggaugaacagccgcuccaccagccuguccgugagccucguccuggugggcguggucacccuguaccucggggugauggugcaggccgacuccggcugcgucgugagcuggaagaacaaggagcugaagugcggcuccgggaucuucaucaccgacaacgugcacacguggaccgagcaguacaaguuccagcccgaguccccgcccaagcuggcgagcgccauccagaaggcccacgaggagggcaucugcgggauccgguccgucacccgccucgagaaccugauguggaagcagaucaccccggagcugaaccacauccucagcgagaacgaggugaagcugacgaucaugaccggcgacaucaaggggaucaugcaggccggcaagcggucccugcgcccccagcccaccgagcucaaguacagcuggaagaccuggggcaaggccaagaugcuguccacggagagccacaaccagaccuuccugaucgacgggccggagaccgcggagugccccaacaccaaccgggccuggaacucccucgagguggaggacuacggcuucggggucuucagcacgaacaucuggcugaagcugcgcgagaagcaggacguguucugcgacuccaagcucaugagcgccgccaucaaggacaaccgggccgugcacgcggacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgccgggccggugucccagcacaacuaccgccccggcuaccacacccagaccgccgggcccuggcaccugggcaagcuggagauggacuucgacuucugcgaggggacgaccgucguggugaccgaggacugcggcaaccggggccccagccuccgcaccacgaccgcgagcgggaagcugaucaccgaguggugcugccgguccugcacccugccgccccuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggcggugagcuucgucacccugaucacggggaacauguccuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccagcaaggagcugaugauggccaccaucggcaucgcccuccugucccagagcaccaucccggagacgauccuggagcucaccgacgcccuggcgcuggggaugaugguccucaagaucgugcgcaacauggagaaguaccagcuggccgugaccaucauggccaucuccugcguccccaacgccgugauccugcagaacgccuggaaggugagcugcaccauccucgcggccgucuccgugagcccccugcugcucacguccagccagcagaaggccgacuggaucccccuggcccugaccaucaagggccucaacccgaccgcgaucuuccugaccacgcugucccggaccagcaagaagcgcuccuggccccucaacgaggccgucauggccgugggcauggugagcauccuggccuccagccugcucaagaacgacauccccaugaccgggccccuggucgccggcgggcugcucaccgugugcuacgugcugacgggccggagcgcggaccuggagcucgagcgcgccgccgacgucaagugggaggaccaggccgagaucuccgggagcuccccgauccugagcaucaccaucuccgaggacggcagcauguccaucaagaacgaggaggaggagcacacccugaccauccucauccggacgggccugcuggugaucagcgggguguuccccgucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacccgcggggccgugcucaugcaccgcggcaagcggaucgagccgagcugggccgacgugaagaaggaccugaucuccuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucagccucgacuucuccccgggcacgagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugaccaucauggaccuccaccccggcgcggggaagacgaagcgguaccugccggccaucgugcgcgaggccaucaagcggggccugcgcacccugauccucgcccccacccgcguggucgccgcggagauggaggaggcccugcgggggcugcccauccgcuaccagacccccgccauccgggccgagcacacgggccgcgagaucguggaccucaugugccacgccaccuucaccaugcggcugcugagcccggugcgcguccccaacuacaaccucaucaucauggacgaggcgcacuucaccgaccccgccuccaucgccgcccggggcuacaucagcacgcgcguggagaugggggaggccgcgggcaucuucaugaccgccacgccgcccgggucccgggaccccuucccccagagcaacgcccccaucauggacgaggagcgcgagauccccgagcgguccuggaacagcggccacgagugggugaccgacuucaaggggaagacggucugguucgugcccuccaucaaggccggcaacgacaucgcggccugccugcgcaagaacggcaagaaggugauccagcugagccggaagaccuucgacuccgaguacgucaagacccgcgccaacgacugggacuucguggugaccacggacaucagcgagaugggggccaacuuccgggccgagcgcgucaucgacccccggcgcugcaugaagcccgugauccucaccgacggcgaggagcgggugauccuggcggggccgaugcccgucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacaccccggagggcaucauccccuccauguucgagcccgagcgggagaagguggacgcgaucgacggggaguaccgccugcggggcgaggcccgcaagacguucguggaccucaugcggcgcggggaccugccggucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccccgguggcuggacgcccgcaucuacagcgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucagcgagcugccggagacccuggagacgcuccugcugcucacccugcuggccaccgugaccggcggcaucuuccucuuccugauguccgggaagggcaucgggaagaugacgcugggcaugugcugcaucaucaccgccagcauccuccugugguacgcccagauccagccccacuggaucgcggccuccaucauccuggaguucuuccucaucgugcugcugauccccgagcccgagaagcagcggaccccgcaggacaaccagcucaccuacgucgugaucgccauccugaccguggucgccgccacgauggcgaacgagaugggguuccuggagaagaccaagaaggaccucggccugggcagcaucaccacccaggagcccgagagcaacauccuggacaucgaccuccgccccgccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccgcucagcaagauggacaucggcgucccccugcuggccaucgggugcuacucccaggugaaccccaucacccucaccgcggcccugcugcuccugguggcccacuacgccaucaucggccccggccugcaggccaaggcgacgcgcgaggcccagaagcgggccgccgccgggaucaugaagaacccgaccgucgacggcaucaccgugaucgaccucgagcccauccccuacgaccccaaguucgagaagcagcugggccaggugaugcugcucguccugugcgugacccaggugcugaugaugcgcacgaccugggcgcucugcgaggcccugacccuggccaccggcccgaucagcacgcucugggaggggaaccccggccgguucuggaacaccaccaucgccgucuccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggugucccgcggcagcgccaagcugcggugguucgucgagcgcaacauggugacccccgagggcaagguggucgaccucgggugcggccgcggcgggugguccuacuacugcggcgggcugaagaacgugcgcgaggugaaggggcugaccaagggcgggcccgggcacgaggagccgauccccaugagcacguacggcuggaaccucguccggcugcaguccgggguggacguguucuucacgccgcccgagaagugcgacacccugcucugcgacaucggcgagagcagcccgaaccccaccaucgaggccggccgcacgcugcggguccugaaccucguggagaacuggcugaacaacaacacccaguucugcaucaaggugcugaaccccuacaugccguccgucaucgagaagauggagacccuccagcgcaaguacgggggcgcccuggugcggaacccccugagccgcaacuccacccacgagauguacugggugagcaacgccaccgggaacaucgucuccagcgugaacaugaucucccgcaugcugaucaaccgguucacgaugaagcacaagaaggcgaccuacgagcccgacguggaccucggcagcgggacccgcaacgucggcaucgagaacgagauccccaaccuggacaucaucggcaagcggaucgagaagaucaagcaggagcacgagaccuccuggcacuacgaccaggaccacccguacaagacgugggccuaccacgggagcuacgagaccaagcagaccggcuccgccagcuccauggugaacggggugguccgccugcucaccaagcccugggacguggugcccauggucacgcagauggccaugaccgacaccacccccuucggccagcagcggguguucaaggagaagguggacacgcgcacccaggagccgaaggagggcaccaagaagcugaugcggaucaccgccgaguggcuguggaaggagcucgggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagacgugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacucccugagcggcguggagggggagggccugcacaagcucggcuacauccugcgcgacgucagcaagaaggagggcggggcgauguacgccgacgacaccgccgggugggacacccggaucacccuggaggaccucaagaacgaggagauggugacgaaccacaugaagggcgagcacaagaagcuggccgaggccaucuucaagcugaccuaccagaacaaggugguccgcgugcagcgccccacgccccgggggaccgugauggacaucaucucccgcaaggaccagcggggcagcggccaggucgggacguacggccucaacaccuucaccaacauggaggcgcagcugauccgccagauggagggggagggcaucuucaaguccauccagcggcugaccgugacggaggagaucgccgugcagaacuggcucgcccgcgucggccgggagcgccugagccggauggccaucuccggggacgacugcguggugaagccgcuggacgaccgcuucgccagcgcgcucaccgcccugaacgacaugggcaagguccggaaggacauccagcagugggagcccucccgcggguggaacgacuggacccaggugcccuucugcagccaccacuuccacgagcuggugaugaaggacggccggguccucguggugcccugccgcaaccaggacgagcugaucgggcgggcccgcaucucccagggcgccggcuggagccugaaggagaccgccugccucgggaaguccuacgcgcagauguggacgcugauguacuuccaccggcgcgaccugcggcucgccgccaacgccaucugcagcgccgucccgucccacugggugcccaccagccgcaccaccugguccauccacgcgaagcacgaguggaugaccacggaggacaugcuggccguguggaaccgcgucuggauccaggagaaccccuggauggaggacaagacccccguggagagcugggaggaggugccguaccugggcaagcgggaggaccaguggugcgggucccucaucggccugaccagccgcgccaccugggccaagaacauccagacggcgaucaaccagguccggagccugaucgggaacgaggaguacaccgacuacaugcccuccaugaagcgcuuccggaaggaggaggaggaggccggcgugcucugguga

SEQ ID NO: 9371 - RNA, 9876 nt, Artificial Sequence
  derived and/or modified CDS sequence (opt1) from DENV-2__EU529700__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaaccuggagaaguaccagcuggccgucaccaucauggccaucagcugcgugccgaacgccgugauccuccagaacgccuggaaggucuccugcaccauccuggcggccgugagcgucagcccccugcuccugacgagcucccagcagaaggccgacuggaucccccuggcccucaccaucaagggccugaaccccaccgcgaucuuccugaccacgcucagccggaccuccaagaagcgcagcuggccgcugaacgaggccgugauggccgugggcauggucuccauccuggccagcagccuccugaagaacgacauccccaugaccgggccccugguggccggcgggcuccugaccgugugcuacguccugacgggccgguccgcggaccucgagcuggagcgcgccgccgacgugaagugggaggaccaggccgagaucagcggguccagccccauccuguccaucaccaucagcgaggacggcuccaugagcaucaagaacgaggaggaggagcagacccucaccauccugauccggacgggccugcucgugaucuccggggucuucccggugagcauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacagccagaucggcgcgggggucuacaaggagggcaccuuccacaccauguggcacgugacccgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugucccuggacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucucccccguccgcgugccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcucucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccugaccgacggcgaggagcgggucauccuggcggggcccaugccggugacccacagcuccgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacuccgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaccacccaggaguccgagagcaacauccucgacaucgaccugcgcccggccuccgccuggacgcuguacgccguggccaccaccuucgucacccccaugcuccggcacagcaucgagaacuccagcgugaacgugucccugacggcgaucgccaaccaggccaccguccugauggggcucggccgcggguggccccugagcaagauggacaucggcgugccccugcucgccaucgggugcuacucccaggugaacccgaucacccugaccgcggcccugcuccugcuggucgcccacuacgccaucaucggccccggccuccaggccaaggcgacgcgcgaggcccagaagcgggccgccgccgggaucaugaagaaccccaccguggacggcaucaccgugaucgaccuggagcccaucccguacgaccccaaguucgagaagcagcuggggcaggucaugcuccuggugcugugcgugacccagguccucaugaugcgcacgaccugggcgcugugcgaggcccugacccucgccaccggccccaucagcacgcugugggaggggaaccccggccgguucuggaacaccaccaucgccguguccauggccaacaucuuccgcggcagcuaccuggcgggggccggccuccuguucuccaucaugaagaacaccacgaacacccggcgcgggaccggcaacaucggcgagacccugggggagaaguggaagucccggcucaacgcccugggcaaguccgaguuccagaucuacaagaaguccgggauccaggagguggaccgcacgcuggccaaggagggcaucaagcgcggggagaccgaccaccacgcggucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcacguacggcuggaaccuggugcggcugcagagcgggguggacgucuucuucaccccgcccgagaagugcgacacccuccugugcgacaucggcgaguccagccccaaccccaccaucgaggccggccgcacgcugcgggugcucaaccugguggagaacuggcugaacaacaacacccaguucugcaucaagguccucaacccguacaugcccuccgugaucgagaagauggagacccugcagcgcaaguacgggggcgcccuggugcggaacccccugagccgcaacuccacccacgagauguacugggucagcaacgccaccgggaacaucguguccagcgugaacaugaucucccgcaugcucaucaaccgguucacgaugaagcacaagaaggcgaccuacgagccggacgucgaccugggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggugguccgccuccugaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcucuggaaggagcuggggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcucgucgaccgcgagcggaaccugcaccuggaggggaagugcgagacgugcguguacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggggaacagccuguccggcguggagggggagggccuccacaagcugggcuacauccugcgcgacgucagcaagaaggagggcggcgcgauguacgccgacgacaccgccgggugggacacccggaucacccucgaggaccugaagaacgaggagauggugacgaaccacaugaagggcgagcacaagaagcuggccgaggccaucuucaagcucaccuaccagaacaaggugguccgcgugcagcgcccgacgccccgggggaccgugauggacaucaucucccgcaaggaccagcggggcagcggccaggucgggacguacggccugaacaccuucaccaacauggaggcgcagcugauccgccagauggagggggagggcaucuucaaguccauccagcaccucaccgugacggaggagaucgccgugcagaacuggcuggcccgggucggccgcgagcggcugagccgcauggccaucuccggggacgacugcguggugaagccccucgacgaccgguucgccagcgcgcugaccgcccugaacgacaugggcaagguccgcaaggacauccagcagugggagcccucccggggguggaacgacuggacccaggugccguucugcagccaccacuuccacgagcucgugaugaaggacggccgcguccugguggugcccugccggaaccaggacgagcugaucgggcgcgcccggaucucccagggcgccggcuggagccucaaggagaccgccugccuggggaaguccuacgcgcagauguggacgcugauguacuuccaccgccgggaccuccgccuggccgccaacgccaucugcagcgccguccccucccacugggugcccaccagccggaccaccugguccauccacgcgaagcacgaguggaugaccacggaggacaugcuggccguguggaaccgcgucuggauccaggagaacccguggauggaggacaagacccccguggagagcugggaggaggugcccuaccucggcaagcgcgaggaccaguggugcgggagccugaucggccugaccucccgggccaccugggccaagaacauccagacggcgaucaaccagguccgcagccucaucgggaacgaggaguacaccgacuacaugcccuccaugaagcgguuccgcaaggaggaggaggaggccggcgugcugugguga

SEQ ID NO: 9372 - RNA, 9876 nt, Artificial Sequence
  derived and/or modified CDS sequence (opt1) from DENV-2__EU529701__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccgucgggaaggcccugcaccagguguucggcgcgaucuacggcgccgccuucagcgggguguccuggaccaugaagaucuucaucggcgucaucaucacguggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggaggucgaggacuacggcuucgggguguucacgaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacccagacggcggggcccuggcaccucggcaagcuggagauggacuucgacuucugcgaggggaccaccgugguggucaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcgugggcaccaagcacgcgauccugcucguggccgucagcuucgugacgcugaucaccgggaacauguccuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucgugcgcaacauggagaaguaccagcucgccgucaccaucauggccaucuccugcgugccgaacgccgugauccugcagaacgcguggaaggucagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggugagcauccucgccuccagccugcugaagaacgacauccccaugaccgggccccucgucgcgggcgggcugcugacggugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggguguucccggucuccauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacucccagaucggcgccgggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgcggugcagaccaagcccggccuguucaagaccaacaccgggacgaucggcgccgucagccucgacuucucccccggcaccagcgggucccccaucguggaccggaagggcaagguggucgggcuguacggcaacggcguggugacccgcagcggggccuacgucuccgccaucgcgcagaccgagaaguccaucgaggacaaccccgagaucgaggacgacaucuuccggaagaagcgccugacgaucauggaccuccaccccggcgccgggaagaccaagcgguaccugcccgccaucgugcgcgaggccaucaagcggggccugcgcacccugauccucgccccgacccgcguggucgcggccgagauggaggaggcccugcgggggcugcccauccgcuaccagacgcccgccauccgggccgagcacaccggccgcgagaucguggaccucaugugccacgcgaccuucaccaugcggcugcugagccccgugcgcgucccgaacuacaaccucaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggcgggcaacgacaucgccgccugccugcgcaagaacggcaagaaggugauccagcugagccggaagaccuucgacuccgaguacgucaagacccgcgccaacgacugggacuucguggugacgaccgacaucagcgagaugggggccaacuucaaggcggagcgggucaucgacccccgccggugcaugaagcccgugauccucaccgacggcgaggagcgcgugauccuggccgggcccaugccggucacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgcgagaagguggacgccaucgacggggaguaccggcugcgcggcgaggcccggaagaccuucguggaccucaugcgccgcggggaccugcccgucuggcuggccuaccgcguggccgcggagggcaucaacuacgccgaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgcggccggccgcaagucccugacccucaaccugaucacggagauggggcggcugcccaccuucaugacccagaaggcccgcgacgcccucgacaaccuggccgugcugcacaccgcggaggccggcgggaaggccuacaaccacgcccucagcgagcugcccgagacgcuggagacccuccugcugcucacccugcuggccaccgucacgggcggcaucuuccucuuccugauguccgggaagggcaucgggaagaugacccugggcaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacguggucaucgccauccugacggugguggcggccaccauggccaacgagaugggguuccuggagaagaccaagaaggaccucggccugggcagcaucaccacgcaggagagcgaguccaacauccuggacaucgaccuccgcccggccagcgccuggacccuguacgcggucgccaccaccuucgugacgcccaugcugcggcacuccaucgagaacagcuccgugaacgucagccucaccgccaucgccaaccaggcgaccgugcugauggggcugggcaagggguggccccucuccaagauggacaucggcgugccccugcuggccaucgggugcuacagccaggucaacccgaucacccucacggccgcccugcugcuccugguggcccacuacgcgaucaucggccccggccugcaggccaaggccacccgcgaggcccagaagcgggccgcggccgggaucaugaagaaccccaccguggacggcaucaccgucaucgaccucgagcccaucccguacgaccccaaguucgagaagcagcugggccaggugaugcugcucauccugugcgugacgcagguccugaugaugcgcaccaccugggcccucugcgaggcccugacccuggccacgggccccaucuccacccucugggaggggaaccccggccgcuucuggaacaccaccaucgcggugagcauggccaacaucuuccggggcuccuaccuggccggggccggccuccuguucagcaucaugaagaacacgaccaacacccgccgggggaccggcaacaucggcgagacgcugggggagaaguggaagucccgccugaacgcgcucggcaagagcgaguuccagaucuacaagaaguccgggauccaggagguggaccggacccuggccaaggagggcaucaagcgcggggagaccgaccaccacgccgucagccggggcuccgccaagcugcgcugguucguggagcggaacauggugaccccggagggcaaggucguggaccucgggugcggccgcgggggcuggagcuacuacugcgggggccugaagaacgugcgggaggucaagggccugacgaagggcgggcccgggcacgaggagcccauccccauguccaccuacggcuggaaccucgugcgccugcagagcgggguggacgucuucuucaccccgcccgagaagugcgacacccugcucugcgacaucggcgagagcucccccaaccccacgaucgaggccggccggacccugcgcgugcugaaccucguggagaacuggcugaacaacaacacccaguucugcaucaagguccugaacccguacaugcccagcgugaucgagaagauggagacccuccagcggaaguacgggggcgcgcuggugcgcaacccccugucccggaacagcacccacgagauguacugggucuccaacgccacggggaacaucgugagcuccgugaacaugaucagccgcaugcugaucaaccgguucaccaugaagcacaagaaggccaccuacgagccggacgucgaccucggcuccgggacccgcaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggugguccggcugcucacgaagcccugggacguggugccgauggucacccagauggcgaugaccgacaccacgcccuucggccagcagcgcguguucaaggagaagguggacacccggacccaggagcccaaggagggcaccaagaagcugaugaagaucacggccgaguggcuguggaaggagcucgggaagaagaagacgccccggaugugcacccgggaggaguucacccgcaagguccggagcaacgccgcccugggcgccaucuucacggacgagaacaaguggaaguccgcgcgcgaggccguggaggacagccgguucugggagcugguggaccgcgagcggaaccuccaccuggaggggaagugcgagaccugcgucuacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcaccgccucggcuacauccugcgggacgucagcaagaaggagggcggggccauguacgccgacgacaccgccgggugggacacccgcaucacgcuggaggaccucaagaacgaggagauggugaccaaccacaugaagggcgagcacaagaagcuggcggaggccaucuucaagcugaccuaccagaacaaggugguccgggugcagcgcccgacgccccgggggacggugauggacaucaucucccgccgcgaccagcggggcagcggccaggucgggaccuacggccucaacaccuucaccaacauggaggcccagcugauccgccagauggagggggagggcaucuucaaguccauccagcaccugacggugaccgaggagaucgccgugcagaacuggcucgcccgggucggccgcgagcggcugagccgcauggcgaucuccggggacgacugcguggugaagccccuggacgaccgguucgccagcgcccucaccgcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgcgggcuggagccugaaggagacggccugccucgggaaguccuacgcccagauguggacccugauguacuuccaccgccgggaccugcgccucgccgccaacgcgaucugcagcgccguccccucccacugggugcccaccagccggaccaccugguccauccacgccaagcacgaguggaugacgaccgaggacaugcuggccguguggaaccgcgucuggauccaggagaacccguggauggaggacaagacccccguggagagcugggaggaggugcccuaccugggcaagcgggaggaccaguggugcgggagccucaucggccugaccucccgcgcgacgugggccaagaacauccagaccgccaucaaccagguccgcagccugaucgggaacgaggaguacaccgacuacaugcccuccaugaagcgguuccgccgggaggaggaggaggccggcgugcucugguga

SEQ ID NO: 9373 - RNA, 9876 nt, Artificial Sequence
  derived and/or modified CDS sequence (opt1) from DENV-2__EU569704__SS-prME
accgccggcgugaucaucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggcgaagaugcugagcacggagucccacaaccagaccuuccucaucgacgggcccgagaccgccgagugcccgaacaccaaccgggccuggaacagccuggagguggaggacuacggcuucggggucuucacgaccaacaucuggcugaagcuccgcgagaagcaggacguguucugcgacuccaagcugaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccgcccgggcuaccacacccagacggcggggcccuggcaccugggcaagcucgagauggacuucgacuucugcgaggggaccaccgucguggugaccgaggacugcggcaaccggggccccagccugcgcacgaccaccgccagcgggaagcugaucaccgaguggugcugccgguccugcacgcugccgccccugcgcuaccggggcgaggacgggugcugguacggcauggagauccgcccccugaaggagaaggaggagaaccucgucaacagccuggugaccgccgggcacggccagaucgacaacuucucccugggcauccucgggauggcccuguuccuggaggagaugcuccggacccgcgugggcaccaagcacgcgauccugcuggucgccgugagcuucgugacgcucaucaccgggaacauguccuuccgggaccugggccgcgucauggugauggugggggccaccaugaccgacgacaucggcaugggcgucacguaccuggcccuccuggccgcguucaaggugcgccccaccuucgccgccgggcugcuccugcggaagcugaccagcaaggagcucaugauggccaccaucggcaucgcccugcugucccagagcacgauccccgagaccauccucgagcugaccgacgcgcuggcccucgggaugauggugcugaagaucguccgcaacauggagaaguaccagcuggccgugaccaucauggccaucuccugcgugcccaacgccgucauccuccagaacgcguggaaggugagcugcacgauccuggccgccguguccgucagcccccugcuccugaccuccagccagcagaaggccgacuggaucccccuggcgcucaccaucaagggccugaaccccaccgccaucuuccugacgacccucucccggaccagcaagaagcgcuccuggccgcugaacgaggccaucauggccgugggcauggucagcauccuggccuccagccuccugaagaacgacauccccaugaccgggccccugguggcgggcgggcuccugacggugugcuacguccugaccggccggagcgccgaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgugaucagcggggucuucccgguguccauccccaucaccgcggccgccugguaccugugggaggugaagaagcagcgcgccggcguccugugggacgugcccuccccgccgcccguggggaaggccgagcucgaggacggcgcguaccggaucaagcagcgcgggauccugggcuacucccagaucggcgccggggucuacaaggagggcaccuuccacaccauguggcacgugacgcgcggggccgugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggccuguucaagaccaacaccgggacgaucggcgccgugagccuggacuucucccccggcaccagcgggucccccaucguggaccggaagggcaaggucguggggcucuacggcaacggcguggucacccgcagcggggccuacguguccgccaucgcgcagaccgagaaguccaucgaggacaaccccgagaucgaggacgacaucuuccggaagaagcgccugacgaucauggaccugcaccccggcgccgggaagaccaagcgguaccugcccgccaucgugcgcgaggccaucaagcggggccuccgcacccugauccuggccccgacccgcgucguggcggccgagauggaggaggcccuccgggggcugcccauccgcuaccagacgcccgccauccgggccgagcacaccggccgcgagaucguggaccugaugugccacgcgaccuucaccaugcggcuccugagccccguccgcgugccgaacuacaaccugaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggcgggcaacgacaucgccgccugccuccgcaagaacggcaagaaggucauccagcugagccggaagaccuucgacuccgaguacgugaagacccgcgccaacgacugggacuucguggucacgaccgacaucagcgagaugggggccaacuucaaggcggagcgggugaucgacccccgccggugcaugaagcccgugauccugaccgacggcgaggagcgcgucauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgcgagaagguggacgccaucgacggggaguaccggcugcgcggcgaggcccggaagaccuucgucgaccugaugcgccgcggggaccuccccguguggcuggccuaccgcguggccgcggagggcaucaacuacgccgaccggcgcuggugcuucgacgggaucaagaacaaccagauccuggaggagaacgucgagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucacggagauggggcggcugcccaccuucaugacccagaaggcccgcgacgcccuggacaaccucgccgugcugcacaccgcggaggccggcgggcgggccuacaaccacgcccugagcgagcuccccgagacgcuggagacccugcuccugcugacccuccuggccaccgucacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucgugcuccugauccccgagcccgagaagcagcgcacgccccaggacaaccagcugaccuacgucgugaucgccauccucacgguggucgcggccaccauggccaacgagaugggguuccuggagaagaccaagaaggaccugggccucggcagcaucaccacgcaggagagcgaguccaacauccuggacaucgaccugcggccggccagcgccuggacccucuacgcgguggccaccaccuucgugacgcccaugcugcgccacuccaucgagaacagcuccgucaacgugagccugaccgccaucgccaaccaggcgaccgugcucauggggcugggcaagggguggccccuguccaagauggacaucggcgucccccuccuggccaucgggugcuacagccaggugaacccgaucacccugacggccgcccuccugcugcucguggcccacuacgcgaucaucggccccggccugcaggccaaggccacccgggaggcccagaagcgcgccgcggccgggaucaugaagaaccccaccgucgacggcaucaccgugaucgaccuggagcccaucccguacgaccccaaguucgagaagcagcucggccaggugaugcugcugauccucugcgucacccaggugcugaugaugcgcaccaccugggcccugugcgaggcccucacccuggccacgggccccaucuccacccugugggaggggaaccccggccgguucuggaacaccaccaucgcggugagcauggccaacaucuuccgcggcuccuaccucgccggggccggccugcuguucagcaucaugaagaacacgaccaacacccggcgcgggaccggcaacaucggcgagacgcucggggagaaguggaagucccggcugaacgcgcugggcaagagcgaguuccagaucuacaagaaguccgggauccaggaggucgaccgcacccucgccaaggagggcaucaagcgcggggagaccgaccaccacgccgugagccgcggcuccgccaagcugcggugguucguggagcgcaacauggucaccccggagggcaaggugguggaccuggggugcggccgcggcggguggagcuacuacugcggcgggcucaagaacguccgcgaggugaaggggcugacgaagggcggccccgggcacgaggagcccauccccauguccaccuacggcuggaaccuggugcggcuccagagcggggucgacguguucuucaccccgcccgagaagugcgacacccugcugugcgacaucggcgagagcucccccaaccccacgaucgaggccggccgcacccuccgggugcugaaccuggucgagaacuggcucaacaacaacacccaguucugcaucaaggugcugaacccguacaugcccagcgugaucgagaagauggagacccugcagcgcaaguacgggggcgcgcugguccggaacccccucucccgcaacagcacccacgagauguacuggguguccaacgccacggggaacaucgugagcuccgucaacaugaucagccggaugcugaucaaccgcuucaccaugaagcacaagaaggccaccuacgagccggacguggaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggucgugcgccugcugacgaagcccugggacguggucccgauggugacccagauggcgaugaccgacaccacgcccuucggccagcagcggguguucaaggagaaggucgacacccgcacccaggagcccaaggagggcaccaagaagcucaugaagaucacggccgaguggcuguggaaggagcuggggaagaagaagacgccccggaugugcacccgcgaggaguucacccggaaggugcgcagcaacgccgcccucggcgccaucuucacggacgagaacaaguggaaguccgcgcgggaggccguggaggacagccgcuucugggagcugaucgaccgggagcgcaaccugcaccucgaggggaagugcgagaccugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgugagcaagaaggagggcggcgccauguacgccgacgacaccgccgggugggacacccggaucacgcuggaggaccugaagaacgaggagauggucaccaaccacaugaagggcgagcacaagaagcucgcggaggccaucuucaagcugaccuaccagaacaaggugguccgcgugcagcggccgacgccccgcgggaccgugauggacaucaucucccgccgggaccagcgcggcagcggccaggucgggaccuacggccugaacaccuucaccaacauggaggcccagcucauccggcagauggagggggagggcaucuucaaguccauccagcaccugacggugaccgaggagaucgccgugcagaacuggcuggcccgcgucggccgggagcgccucagccggauggcgaucuccggggacgacugcguggugaagccccuggacgaccgcuucgccagcgcccugaccgcccucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucgggcgggcccgcaucucccagggcgcgggcuggagccugaaggagacggccugccuggggaaguccuacgcccagauguggacccucauguacuuccaccggcgcgaccugcggcuggccgccaacgcgaucugcagcgccguccccucccacugggugcccaccagccgcaccaccugguccauccacgccaagcacgaguggaugacgaccgaggacaugcucgccguguggaaccgggucuggauccaggagaacccguggauggaggacaagacccccguggagagcugggaggaggugcccuaccugggcaagcgcgaggaccaguggugcgggagccugaucggccucaccucccgcgcgacgugggccaagaacauccagaccgccaucaaccagguccggagccugaucgggaacgaggaguacaccgacuacaugcccuccaugaagcgcuuccggcgcgaggaggaggaggccggcgugcugugguga

SEQ ID NO: 9374 - RNA, 9876 nt, Artificial Sequence
  derived and/or modified CDS sequence (opt1) from DENV-2__EU482568__SS-prME
accgccggcgugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacauccgggggaucaugcaggccggcaagcgcagccuccggccgcagcccaccgagcugaaguacuccuggaagaccuggggcaaggcgaagaugcugagcacggagucccacaaccagaccuuccucaucgacgggcccgagaccgccgagugcccgaacaccaaccgcgccuggaacagccuggagguggaggacuacggcuucggggucuucacgaccaacaucuggcugaagcuccgggagaagcaggacguguucugcgacuccaagcugaugagcgccgccaucaaggacaaccgcgcggugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccggccgggcuaccacacccagacggcggggcccuggcaccugggcaagcucgagauggacuucgacuucugcgaggggaccaccgucguggugaccgaggacugcggcaaccgcggccccagccugcggacgaccaccgccagcgggaagcugaucaccgaguggugcugccgcuccugcacgcugccgccccugcgguaccgcggcgaggacgggugcugguacggcauggagauccggccccugaaggagaaggaggagaaccucgucaacagccuggugaccgccgggcacggccagaucgacaacuucucccugggcauccucgggauggcccuguuccuggaggagaugcuccgcacccgggugggcaccaagcacgcgauccugcuggucgccgugagcuucgugacgcucaucaccgggaacauguccuuccgcgaccugggccgcgucauggugauggugggggccaccaugaccgacgacaucggcaugggcgucacguaccuggcccuccuggccgcguucaaggugcggcccaccuucgccgccgggcugcuccugcgcaagcugaccagcaaggagcucaugauggccaccaucggcaucgcccugcugucccagagcacgauccccgagaccauccucgagcugaccgacgcgcuggcccucgggaugauggugcugaagaucguccggaacauggagaaguaccagcuggccgugaccaucauggccaucuccugcgugcccaacgccgucauccuccagaacgcguggaaggugagcugcacgauccuggccgccguguccgucagcccccugcuccugaccuccagccagcagaaggccgacuggaucccccuggcgcucaccaucaagggccugaaccccaccgccaucuuccugacgacccucucccgcaccagcaagaagcgguccuggccgcugaacgaggccaucauggccgugggcauggucagcauccuggccuccagccuccugaagaacgacauccccaugaccgggccccugguggcgggcgggcuccugacggugugcuacguccugaccggccgcagcgccgaccucgagcuggagcgggccgccgacgugaagugggaggaccaggccgagaucuccgggagcucccccauccugagcaucaccaucuccgaggacggcagcauguccaucaagaacgaggaggaggagcagacccucacgauccugauccgcaccggccugcucgugaucagcggggucuucccgguguccauccccaucaccgcggccgccugguaccugugggaggugaagaagcagcgggccggcguccugugggacgugcccuccccgccgcccguggagaaggccgagcucgaggacggggcguaccgcaucaagcagcggggcauccugggguacucccagaucggcgccggcgucuacaaggaggggaccuuccacaccauguggcacgugacgcgcggcgccgugcugaugcaccgggggaagcgcgucgagcccagcugggccgacgugaagaaggaccucaucuccuacggcgggggcuggaagcuggagggcgaguggaaggagggggaggaggugcagguccuggcccucgagcccggcaagaacccccgggcggugcagaccaagcccgggcuguucaagaccaacaccggcacgaucggggccgugagccuggacuucucccccggcaccagcggcucccccaucgucgaccgcaaggggaagguggugggccucuacgggaacggcgucgugacccggagcggcgccuacguguccgccaucgcgcagaccgagaaguccaucgaggacaaccccgagaucgaggacgacaucuuccgcaagaagcggcugacgaucauggaccugcaccccggggccggcaagaccaagcgcuaccugcccgccaucguccgggaggccaucaagcgcgggcuccgcacccugauccuggccccgacccgggugguggcggccgagauggaggaggcccuccgcggccugcccauccgguaccagacgcccgccauccgcgccgagcacaccgggcgggagaucgucgaccugaugugccacgcgaccuucaccaugcgccuccugagccccgugcgggugccgaacuacaaccugaucaucauggacgaggcccacuucacggaccccgccuccaucgccgcccgcggcuacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugacggacuucaagggcaagaccgugugguucgucccguccaucaaggcggggaacgacaucgccgccugccuccggaagaacggcaagaaggugauccagcugagccgcaagaccuucgacuccgaguacgugaagacccgggccaacgacugggacuucgucgugacgaccgacaucagcgagaugggcgccaacuucaaggcggagcgcgugaucgacccccggcgcugcaugaagcccgucauccugaccgacggggaggagcgggugauccucgccggccccaugccggugacccacuccagcgccgcccagcgccgcgggcggaucggccgcaaccccaagaacgagaacgaccaguacaucuacaugggggagccccuggagaacgacgaggacugcgcccacuggaaggaggcgaagaugcugcucgacaacaucaacacgcccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggccuaccgggucgccgcggaggggaucaacuacgccgaccgccgguggugcuucgacggcaucaagaacaaccagauccuggaggagaacguggagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccgggacgcccuggacaaccucgccguccugcacaccgcggaggccgggggccgcgccuacaaccacgcccugagcgagcuccccgagacgcuggagacccugcuccugcugacccuccuggccaccgugaccgggggcaucuuccuguuccucauguccggcaaggggaucggcaagaugacccuggggaugugcugcaucaucaccgcgagcauccugcucugguacgcccagauccagccgcacuggaucgccgccuccaucauccuggaguucuuccugaucguccuccugauccccgagcccgagaagcagcggacgccccaggacaaccagcugaccuacguggugaucgccauccucacggucguggcggccaccauggccaacgagaugggcuuccuggagaagaccaagaaggaccuggggcucggcagcaucaccacgcaggagagcgaguccaacauccuggacaucgaccugcgcccggccagcgccuggacccucuacgcgguggccaccaccuucgucacgcccaugcugcggcacuccaucgagaacagcuccgugaacgugagccugaccgccaucgccaaccaggcgaccguccucaugggccuggggaagggcuggccccuguccaagauggacaucggggugccccuccuggccaucggcugcuacagccaggugaacccgaucacccugacggccgcccuccugcugcucgucgcccacuacgcgaucaucgggcccggccugcaggccaaggccacccgcgaggcccagaagcgcgccgcggccggcaucaugaagaaccccaccguggacgggaucaccgugaucgaccuggagcccaucccguacgaccccaaguucgagaagcagcucggccaggucaugcugcugauccucugcgugacccaggugcugaugaugcggaccaccugggcccugugcgaggcccucacccuggccacggggcccaucuccacccugugggagggcaaccccgggcgcuucuggaacaccaccaucgcggucagcauggccaacaucuuccggggcuccuaccucgccggcgccgggcugcuguucagcaucaugaagaacacgaccaacacccgccggggcaccgggaacaucggcgagacgcucggcgagaaguggaagucccgccugaacgcgcugggcaagagcgaguuccagaucuacaagaaguccggcauccaggagguggaccggacccucgccaaggaggggaucaagcgcggcgagaccgaccaccacgccgugagccggggguccgccaagcugcgcugguucgucgagcggaacauggugaccccggagggcaagguggucgaccugggcugcgggcgcggcggguggagcuacuacugcggcgggcucaagaacgugcgggaggugaagggccugacgaagggcgggcccggccacgaggagcccauccccauguccaccuacggguggaaccugguccgccuccagagcggcguggacguguucuucaccccgcccgagaagugcgacacccugcugugcgacaucggggagagcucccccaaccccacgaucgaggccggccggacccuccgcguccugaaccugguggagaacuggcucaacaacaacacccaguucugcaucaaggugcugaacccguacaugcccagcgucaucgagaagauggagacccugcagcggaaguacggcggggcgcuggugcgcaacccccucucccggaacagcacccacgagauguacuggguguccaacgccacgggcaacaucgucagcuccgugaacaugaucagccgcaugcugaucaaccgcuucaccaugaagcacaagaaggccaccuacgagccggacguggaccugggguccggcacccggaacaucgggaucgagagcgagauccccaaccucgacaucaucggcaagcgcaucgagaagaucaagcaggagcacgagacguccuggcacuacgaccaggaccaccccuacaagaccugggccuaccacggcagcuacgagaccaagcagaccggguccgccagcuccauggucaacggcguggugcggcugcugacgaagcccugggacgucgugccgauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagacgccccgcaugugcacccgggaggaguucacccgcaaggugcggagcaacgccgcccucggggccaucuucacggacgagaacaaguggaaguccgcgcgcgaggccgucgaggacagccgguucugggagcugaucgaccgcgagcggaaccugcaccucgagggcaagugcgagaccugcguguacaacaugauggggaagcgcgagaagaagcugggcgaguucgggaaggccaagggcucccgggccaucugguacauguggcugggcgcgcgcuuccucgaguucgaggcccugggguuccugaacgaggaccacugguucagccggggcaacagccucuccgggguggagggcgaggggcugcaccgccugggcuacauccuccgggacgucagcaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggucgugcgggugcagcgcccgacgccccgcggcaccgucauggacaucaucucccggcgcgaccagcgggggagcggccaggugggcaccuacgggcugaacaccuucaccaacauggaggcccagcucauccgccagauggagggcgaggggaucuucaaguccauccagcaccugacggugaccgaggagaucgccguccagaacuggcuggcccgggugggccgcgagcggcucagccgcauggcgaucuccggcgacgacugcguggucaagccccuggacgaccgguucgccagcgcccugaccgcccucaacgacauggggaaggugcgcaaggacauccagcagugggagcccucccggggcuggaacgacuggacccaggugccguucugcagccaccacuuccacgagcuggucaugaaggacgggcgcgugcuggugguccccugccggaaccaggacgagcucaucggccgcgcccggaucucccagggggcgggcuggagccugaaggagacggccugccugggcaaguccuacgcccagaugugggcccucauguacuuccaccgccgggaccugcgccuggccgcgaacgccaucugcagcgccgugcccucccacugggugcccaccagccggaccaccugguccauccacgccaagcacgaguggaugaccacggaggacaugcucgcggucuggaaccgcguguggauccaggagaacccguggauggaggacaagacccccguggagagcugggaggagguccccuaccuggggaagcgcgaggaccaguggugcggcagccugaucgggcucaccucccgggccaccugggccaagaacauccagacggccaucaaccaggugcgcagccugaucggcaacgaggaguacaccgacuacaugcccuccaugaagcgguuccgccgggaggaggaggaggccggggugcugugguga

SEQ ID NO: 9375 - RNA, 9876 nt, Artificial Sequence
  derived and/or modified CDS sequence (opt1) from DENV-2__EU482569__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaagaacaaggagcugaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucaccaucauggccaucuccugcgugccgaacgccgugauccugcagaacgcguggaaggucagcugcacgauccucgccgccguguccgucagcccccugcugcucaccuccagccagcagaaggccgacuggaucccccuggcgcugaccaucaagggccucaaccccaccgccaucuuccugacgacccugucccggaccagcaagaagcgcuccuggccgcucaacgaggccaucauggccgugggcauggugagcauccuggccuccagccugcucaagaacgacauccccaugaccgggccccuggucgcgggcgggcugcucacggugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacccugacgauccucauccggaccggccugcuggugaucagcgggguguucccggucuccauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacucccagaucggcgccgggguguacaaggagggcaccuuccacaccauguggcacgucacgcgcggggccgugcugaugcaccgcggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgcggugcagaccaagcccggccucuucaagaccaacaccgggacgaucggcgccgucagccuggacuucucccccggcaccagcgggucccccaucguggaccggaagggcaagguggucgggcuguacggcaacggcguggugacccgcagcggggccuacgucuccgccaucgcgcagaccgagaaguccaucgaggacaaccccgagaucgaggacgacaucuuccggaagaagcgccucacgaucauggaccugcaccccggcgccgggaagaccaagcgguaccugcccgccaucgugcgcgaggccaucaagcggggccugcgcacccucauccuggccccgacccgcguggucgcggccgagauggaggaggcccugcgggggcuccccauccgcuaccagacgcccgccauccgggccgagcacaccggccgcgagaucguggaccugaugugccacgcgaccuucaccaugcggcugcucagccccgugcgcgucccgaacuacaaccugaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggcgggcaacgacaucgccgccugccugcgcaagaacggcaagaaggugauccagcucagccggaagaccuucgacuccgaguacgucaagacccgcgccaacgacugggacuucguggugacgaccgacaucagcgagaugggggccaacuucaaggcggagcgggucaucgacccccgccggugcaugaagcccgugauccugaccgacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacgcccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacagcgacccccuggcccugaaggaguucaaggaguucgcggccggccgcaagucccucacccugaaccugaucacggagauggggcggcuccccaccuucaugacccagaaggcccgcgacgcccuggacaaccuggccgugcuccacaccgcggaggccggcgggcgggccuacaaccacgcccugagcgagcugcccgagacgcucgagacccugcugcuccugacccugcucgccaccgucacgggcggcaucuuccuguuccugauguccgggaagggcaucgggaagaugacccucggcaugugcugcaucaucaccgcgagcauccugcugugguacgcccagauccagccgcacuggaucgccgccuccaucauccucgaguucuuccugaucgugcugcucauccccgagcccgagaagcagcgcacgccccaggacaaccagcugaccuacguggucaucgccauccugacggugguggcggccaccauggccaacgagaugggguuccucgagaagaccaagaaggaccugggccugggcagcaucaccacgcaggagagcgaguccaacauccucgacaucgaccugcggccggccagcgccuggacccuguacgcggucgccaccaccuucgugacgcccaugcuccgccacuccaucgagaacagcuccgugaacgucagccugaccgccaucgccaaccaggcgaccgugcugauggggcucggcaagggguggccccuguccaagauggacaucggcgugccccugcucgccaucgggugcuacagccaggucaacccgaucacccugacggccgcccugcuccugcugguggcccacuacgcgaucaucggccccggccuccaggccaaggccacccgggaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacgcagguccucaugaugcgcaccaccugggcccugugcgaggcccugacccucgccacgggccccaucuccacccugugggaggggaaccccggccgguucuggaacaccaccaucgcggugagcauggccaacaucuuccgcggcuccuaccuggccggggccggccuccuguucagcaucaugaagaacacgaccaacacccggcgcgggaccggcaacaucggcgagacgcugggggagaaguggaagucccggcucaacgcgcugggcaagaacgaguuccagaucuacaagaaguccgggauccaggagguggaccgcacccuggccaaggagggcaucaagcgcggggagaccgaccaccacgccgucucccgcggcagcgccaagcuccggugguucguggagcgcaacauggugaucccggagggcaaggucguggaccuggggugcggccgcggcgggugguccuacuacugcggcgggcugaagaacgugcgcgaggucaaggggcucaccaagggcgggcccgggcacgaggagcccauccccaugagcacguacggcuggaaccuggugcggcugcaguccgggguggacgucuucuucaccccgcccgagaagugcgacacccuccugugcgacaucggcgagagcagccccaaccccaccaucgaggccggccgcacgcugcgggugcucaaccugguggagaacuggcugaacaacaacacccaguucugcaucaagguccucaacccguacaugcccuccgugaucgagaagauggagacccugcagcgcaaguacgggggcgcgcuggugcggaacccccugagccgcaacuccacccacgagauguacugggucagcaacgccaccgggaacaucguguccagcgugaacaugaucucccggaugcucaucaaccgcuucacgaugaagcacaagaaggccaccuacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacggggugguccgccuccugaccaagcccugggacguggugccgauggucacgcagauggcgaugaccgacaccacccccuucggccagcagcggguguucaaggagaagguggacacgcgcacccaggagcccaaggagggcaccaagaagcugaugaagaucaccgccgaguggcucuggaaggagcuggggaagaagaagacgccccggaugugcacccgcgaggaguucacccggaagguccgcuccaacgccgcccugggcgccaucuucaccgacgagaacaaguggaaguccgcgcgggaggccguggaggacucccgcuucugggagcucaucgaccgggagcgcaaccugcaccuggaggggaagugcgagacgugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgggaacagccugagcggcgucgagggggagggccuccaccggcugggcuacauccugcgcgacguguccaagaaggagggcggggccauguacgccgacgacaccgccgggugggacacccggaucacccucgaggaccugaagaacgaggagauggucacgaaccacaugaagggcgagcacaagaagcuggcggaggccaucuucaagcucaccuaccagaacaagguggugcgcguccagcggccgacgccccgggggaccgugauggacaucaucagccgccgggaccagcgcggcuccggccagguggggacguacggccugaacaccuucaccaacauggaggcccagcugauccggcagauggagggggagggcaucuucaagagcauccagcaccucaccgucacggaggagaucgccgugcagaacuggcuggcccgcgugggccgggagcgccugucccggauggcgaucagcggggacgacugcgucgugaagccccucgacgaccgcuucgccuccgcccugaccgcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucgggcgggcccgcaucagccagggcgcgggcuggucccucaaggagaccgccugccugggcaagagcuacgcccagauguggacgcugauguacuuccaccggcgcgaccuccggcuggccgccaacgcgaucugcuccgccgugcccagccacuggguccccaccucccgcaccaccuggagcauccacgccaagcacgaguggaugaccacggaggacaugcuggccguguggaaccggguguggauccaggagaacccguggauggaggacaagacccccgucgaguccugggaggaggugcccuaccucggcaagcgcgaggaccaguggugcgggagccugaucggccugaccagccgcgcgaccugggccaagaacauccagacggccaucaaccaggugcggucccucaucgggaacgaggaguacaccgacuacaugcccagcaugaagcgcuuccggcgcgaggaggaggaggccggcguccugugguga

SEQ ID NO: 9376 - RNA, 9876 nt, Artificial Sequence
  derived and/or modified CDS sequence (opt1) from DENV-2__EU482570__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccgcaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccucgagaaccugauguggaagcaggucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucaccaucauggccaucuccugcgugccgaacgccgugauccugcagaacgcguggaaggucggcugcacgauccucgccgccgugagcgucagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccguggggaugguguccauccuggccagcucccugcucaagaacgacauccccaugaccggcccccuggucgccgggggccugcucacggugugcuacgugcugaccgggcggagcgccgaccuggagcucgagcgcgccgccgacgucaagugggaggaccaggccgagaucagcggcuccagccccauccuguccaucaccaucagcgaggacggcuccaugagcaucaagaacgaggaggaggagcagacccugacgauccucauccggaccgggcugcuggugaucuccggcguguucccggucagcauccccaucaccgcggccgccugguaccucugggaggugaagaagcagcgcgccggggugcugugggacguccccagcccgccgcccgugggcaaggccgagcuggaggacggggcguaccggaucaagcagcgcggcauccucggcuacagccagaucggggccggcguguacaaggaggggaccuuccacaccauguggcacgucacgcggggcgccgugcugaugcaccgcgggaagcggaucgagcccuccugggccgacgugaagaaggaccugaucagcuacggcggcggguggaagcucgagggcgaguggaaggagggggaggagguccaggugcuggcccuggagcccggcaagaacccccgcgcggugcagaccaagcccggccucuucaagaccaacaccggcacgaucggcgccgucucccuggacuucagccccgggaccuccggcagccccaucguggaccggaaggggaagguggucggccuguacggcaacgggguggugacccgcuccggcgccuacgucagcgccaucgcgcagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcugcgcacccucauccuggccccgacccgcguggucgcggccgagauggaggaggcccugcggggccuccccauccgcuaccagacgcccgccauccgggccgagcacaccggccgcgagaucguggaccugaugugccacgcgaccuucaccaugcggcugcucagccccgugcgcgucccgaacuacaaccugaucaucauggacgaggcccacuucacggaccccgccagcaucgccgcccggggguacaucuccacccgcguggagaugggcgaggcggccgggaucuucaugaccgccacgccgcccggcagccgggacccguucccccaguccaacgcccccaucauggacgaggagcgcgagauccccgagcggagcuggaacuccgggcacgagugggugacggacuucaagggcaagaccgucugguucgugccgagcaucaaggcgggcaacgacaucgccgccugccugcgcaagaacgggaagaaggugauccagcucucccggaagaccuucgacagcgaguacgucaagacccgcgccaacgacugggacuucguggugacgaccgacaucuccgagaugggcgccaacuucaaggcggagcgggucaucgacccccgccggugcaugaagcccgugauccugaccgacggggaggagcgcgugauccuggccggccccaugccggucacccacagcuccgccgcccagcggcgcgggcgcaucggccggaaccccaagaacgagaacgaccaguacaucuacaugggcgagccccucgagaacgacgaggacugcgcccacuggaaggaggcgaagaugcugcuggacaacaucaacacgcccgaggggaucaucccgagcauguucgagcccgagcgcgagaagguggacgccaucgacggcgaguaccggcuccgcggggaggcccggaagaccuucguggaccugaugcgccggggcgaccugcccgucuggcucgccuaccgcguggccgcggaggggaucaacuacgccgaccggcgcuggugcuucgacggcaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccgggcgcaagagccucacccugaaccugaucacggagaugggccggcuccccaccuucaugacccagaaggcccgcgacgcccuggacaaccuggccgugcuccacaccgcggaggccgggggcaaggccuacaaccacgcccuguccgagcugcccgagacgcucgagacccugcugcuccugacccugcucgccaccgucacgggcgggaucuuccuguuccugaugagcggcaaggggaucggcaagaugacccucgggaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggcuuccucgagaagaccaagaaggaccugggccugggguccaucaccacgcaggagagcgagagcaacauccucgacaucgaccugcgcccggccuccgccuggacccuguacgcggucgccaccaccuucgugacgcccaugcuccggcacagcaucgagaacuccagcgugaacgucucccugaccgccaucgccaaccaggcgaccgugcugaugggccucgggaagggcuggccccugagcaagauggacaucggggugccccugcucgccaucggcugcuacucccaggucaacccgaucacccugacggccgcccugcuccugcugguggcccacuacgcgaucaucggccccgggcuccaggccaaggccacccgcgaggcccagaagcgggccgcggccggcaucaugaagaaccccaccguggacgggaucaccgucaucgaccuggagcccaucccguacgaccccaaguucgagaagcagcugggccaggugaugcuccugauccugugcgugacgcagguccucaugaugcgcaccaccugggcccugugcgaggcccugacccucgccacggggcccaucagcacccugugggagggcaaccccggccgcuucuggaacaccaccaucgcgguguccauggccaacaucuuccgggggagcuaccuggccggcgccgggcuccuguucuccaucaugaagaacacgaccaacacccgccggggcaccggcaacaucggggagacgcugggcgagaaguggaagucccgccucaacgcgcuggggaaguccgaguuccagaucuacaagaaguccggcauccaggagguggaccggacccuggccaaggaggggaucaagcgcggcgagaccgaccaccacgccgucucccggggcagcgccaagcuccgcugguucguggagcggaacauggugaccccggaggggaaggucguggaccugggcugcgggcgcggcgggugguccuacuacugcggcggccugaagaacgugcgggaggucaaggggcucacgaagggcgggcccggccacgaggagcccauccccaugagcaccuacggguggaaccuggugcgccugcaguccggcguggacgucuucuucaccccgcccgagaagugcgacacccuccugugcgacaucggcgagagcagccccaaccccacgaucgaggccgggcggacccugcgcgugcucaaccugguggagaacuggcugaacaacaacacccaguucugcaucaagguccucaacccguacaugcccuccgugaucgagaagauggagacccugcagcggaaguacggcggggcgcuggugcgcaacccccugagccggaacuccacccacgagauguacugggucagcaacgccacgggcaacaucguguccagcgugaacaugaucucccgcaugcucaucaaccgguucaccaugaagcacaagaaggccaccuacgagccggacgucgaccuggggagcggcacccgcaacaucggcaucgaguccgagauccccaaccuggacaucaucgggaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgugguccggcuccugacgaagcccugggacguggugccgauggucacccagauggcgaugaccgacaccacgcccuucggccagcagcgcguguucaaggagaagguggacacccggacccaggagcccaaggaggggaccaagaagcugaugaagaucacggccgaguggcucuggaaggagcugggcaagaagaagacgccccgcaugugcacccgggaggaguucacccgcaagguccgguccaacgccgcccugggggccaucuucacggacgagaacaaguggaaguccgcgcgcgaggccguggaggacucccgguucugggagcucguggaccgcgagcggaaccugcaccuggagggcaagugcgagaccugcgucuacaacaugauggggaagcgcgagaagaagcucggcgaguucggcaaggccaaggggagccgggccaucugguacauguggcugggcgcgcgcuuccuggaguucgaggcccucggguuccugaacgaggaccacugguucucccggggcaacagccugagcgggguggagggcgagggccuccaccgccugggguacauccugaaggacgucuccaagaaggagggcggggccauguacgccgacgacaccgccggcugggacacccggaucacgcucgaggaccugaagaacgaggagauggugaccaaccacaugaagggggagcacaagaagcuggcggaggccaucuucaagcucaccuaccagaacaaggugguccgcgugcagcggccgacgccccgcggcacggugauggacaucaucagccggcgcgaccagcgcggcuccgggcaggucggcaccuacgggcugaacaccuucaccaacauggaggcccagcugauccggcagauggagggcgagggcaucuucaagagcauccagcaccucacggugaccgaggagaucgccgugcagaacuggcuggcccgcgucgggcgggagcgccugucccggauggugaucagcggcgacgacugcguggucaagccccucgacgaccgcuucgcguccgcccugaccgcccugaacgacauggggaaggugcggaaggacauccagcagugggagcccagccgcggcuggaacgacuggacccaggugccguucugcucccaccacuuccacgagcucgucaugaaggacgggcgggugcuggugguccccugccgcaaccaggacgagcugaucggccgggcccgcaucagccagggcgccggguggucccucaaggagacggcgugccugggcaagagcuacgcccagauguggacccugauguacuuccaccggcgcgaccuccggcuggccgccaacgccaucugcuccgcggugcccagccacugggugcccaccucccgcaccaccuggagcauccacgccaagcacgaguggaugacgaccgaggacaugcuggccgucuggaaccggguguggauccaggagaacccguggauggaggacaagacccccguggaguccugggaggagguccccuaccucgggaagcgcgaggaccaguggugcggcagccugaucgggcugaccagccgggccacgugggcgaagaacauccagaccgccaucaaccaggugcgcucccucaucggcaacgaggaguacaccgacuacaugcccagcaugaagcgcuuccggcgcgaggaggaggaggccggcgugcugugguga

SEQ ID NO: 9377 - RNA, 9876 nt, Artificial Sequence
  derived and/or modified CDS sequence (opt1) from DENV-2__EU482571__SS-prME
accgccggcgugaucaucaugcugauccccaccgccauggcguuccaccucaccacccggaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggcgaagaugcugagcacggagucccacaaccagaccuuccucaucgacgggcccgagaccgccgagugcccgaacaccaaccgggccuggaacagccuggagguggaggacuacggcuucggggucuucacgaccaacaucuggcugaagcuccgcgagaagcaggacguguucugcgacuccaagcugaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccgcccgggcuaccacacccagacggcggggcccuggcaccugggcaagcucgagauggacuucgacuucugcgaggggaccaccgucguggugaccgaggacugcggcaaccggggccccagccugcgcacgaccaccgccagcgggaagcugaucaccgaguggugcugccgguccugcacgcugccgccccugcgcuaccggggcgaggacgggugcugguacggcauggagauccgcccccugaaggagaaggaggagaaccucgucaacagccuggugaccgccgggcacggccagaucgacaacuucucccugggcgugcucgggauggcccuguuccuggaggagaugcuccggacccgcgucggcaccaagcacgcgauccugcugguggccgugagcuucgucacgcucaucaccgggaacauguccuuccgggaccugggccgcgugauggugauggucggggccaccaugaccgacgacaucggcaugggcgugacguaccuggcccuccuggccgcguucaaggugcgccccaccuucgccgccgggcugcuccugcggaagcugaccagcaaggagcucaugauggccaccaucggcaucgcccugcugucccagagcacgauccccgagaccauccucgagcugaccgacgcgcuggcccucgggaugaugguccugaagaucgugcgcaacauggagaaguaccagcuggccgugaccaucauggccaucuccugcguccccaacgccgugauccuccagaacgcguggaaggugagcugcacgauccuggccgccgucuccgugagcccccugcuccugaccuccagccagcagaaggccgacuggaucccccuggcgcucaccaucaagggccugaaccccaccgccaucuuccugacgacccucucccggaccagcaagaagcgcuccuggccgcugaacgaggccaucauggccgucggcauggugagcauccuggccuccagccuccugaagaacgacauccccaugaccgggccccugguggcgggcgggcuccugacggucugcuacgugcugaccggccggagcgccgaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgucaucagcgggguguucccgguguccauccccaucaccgcggccgccugguaccugugggaggucaagaagcagcgcgccggcgugcugugggacgugcccuccccgccgcccgucgggaaggccgagcucgaggacggcgcguaccggaucaagcagcgcgggauccugggcuacucccagaucggcgccgggguguacaaggagggcaccuuccacaccauguggcacgugacgcgcggggccguccugaugcaccgcggcaagcggaucgagcccagcugggccgacgugaagaaggaccucaucuccuacgggggcggcuggaagcuggagggggaguggaaggagggcgaggaggugcagguccuggcccucgagcccgggaagaacccccgcgcggugcagaccaagcccggccuguucaagaccaacaccgggacgaucggcgccgugagccuggacuucucccccggcaccagcgggucccccaucgucgaccggaagggcaaggugguggggcucuacggcaacggcgucgugacccgcagcggggccuacguguccgccaucgcgcagaccgagaaguccaucgaggacaaccccgagaucgaggacgacaucuuccggaagaagcgccugacgaucauggaccugcaccccggcgccgggaagaccaagcgguaccugcccgccaucguccgcgaggccaucaagcggggccuccgcacccugauccuggccccgacccgcgugguggcggccgagauggaggaggcccuccgggggcugcccauccgcuaccagacgcccgccauccgggccgagcacaccggccgcgagaucgucgaccugaugugccacgcgaccuucaccaugcggcuccugagccccgugcgcgugccgaacuacaaccugaucaucauggacgaggcccacuucacggaccccgccuccaucgccgcccggggcuacaucagcacccgcgucgagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggcgggcaacgacaucgccgccugccuccgcaagaacggcaagaaggugauccagcugagccggaagaccuucgacuccgaguacgugaagacccgcgccaacgacugggacuucgucgugacgaccgacaucagcgagaugggggccaacuucaaggcggagcgggugaucgacccccgccggugcaugaagcccgucauccugaccgacggcgaggagcgcgugauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuaccgcgucgccgcggagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucacggagauggggcggcugcccaccuucaugacccagaaggcccgcgacgcccuggacaaccucgccguccugcacaccgcggaggccggcgggcgggccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucguccuccugauccccgagcccgagaagcagcgcacgccccaggacaaccagcugaccuacguggugaucgccauccucacggucguggcggccaccauggccaacgagaugggguuccuggagaagaccaagaaggaccugggccucggcagcaucaccacgcaggagagcgaguccaacauccuggacaucgaccugcggccggccagcgccuggacccucuacgcgguggccaccaccuucgucacgcccaugcugcgccacuccaucgagaacagcuccgugaacgugagccugaccgccaucgccaaccaggcgaccguccucauggggcugggcaagggguggccccuguccaagauggacaucggcgugccccuccuggccaucgggugcuacagccaggugaacccgaucacccugacggccgcccuccugcugcucgucgcccacuacgcgaucaucggccccggccugcaggccaaggccacccgggaggcccagaagcgcgccgcggccgggaucaugaagaaccccaccguggacggcaucaccgugaucgaccuggagcccaucccguacgaccccaaguucgagaagcagcucgggcaggucaugcugcugauccucugcgugacccaggugcugaugaugcgcaccaccugggcccugugcgaggcccucacccuggccacgggccccaucuccacccugugggaggggaaccccggccgguucuggaacaccaccaucgcggucagcauggccaacaucuuccgcggcuccuaccucgccggggccggccugcuguucagcaucaugaagaacacgaccaacacccggcgcgggaccggcaacaucggcgagacgcucggggagaaguggaagucccggcugaacgcgcugggcaagagcgaguuccagaucuacaagaaguccgggauccaggagguggaccgcacccucgccaaggagggcaucaagcgcggggagaccgaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugacgaagggcggccccgggcacgaggagcccauccccauguccaccuacggcuggaaccugguccggcuccagagcgggguggacguguucuucaccccgcccgagaagugcgacacccugcugugcgacaucggcgagagcucccccaaccccacgaucgaggccggccgcacccuccggguccugaaccugguggagaacuggcucaacaacaacacccaguucugcaucaaggugcugaacccguacaugcccagcgucaucgagaagauggagacccugcagcgcaaguacgggggcgcgcuggugcggaacccccucucccgcaacagcacccacgagauguacuggguguccaacgccacggggaacaucgucagcuccgugaacaugaucagccggaugcugaucaaccgcuucaccaugaagcacaagaaggccaccuacgagccggacguggaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccugcugacgaagcccugggacgucgugccgauggugacccagauggcgaugaccgacaccacgcccuucggccagcagcgggucuucaaggagaagguggacacccgcacccaggagcccaaggagggcaccaagaagcucaugaagaucacggccgccuggcuguggaaggagcuggggaagaagaagacgccccggaugugcacccgcgaggaguucacccggaaggugcgcagcaacgccgcccucggcgcgaucuucacggacgagaacaaguggaaguccgcccgggaggccgucgaggacagccgcuucugggagcugaucgaccgggagcgcaaccugcaccucgaggggaagugcgagaccugcguguacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgggaacagccucuccggcguggagggggagggccugcaccggcugggcuacauccuccgcgacgucagcaagaaggagggcggcgccauguacgccgacgacaccgcggggugggacacccggaucacgcuggaggaccugaagaacgaggagauggugaccaaccacaugaagggcgagcacaagaagcucgccgaggccaucuucaagcugaccuaccagaacaaggucgugcgcgugcagcggccgacgccccgcgggaccgucauggacaucaucucccgccgggaccagcgcggcagcggccagguggggaccuacggccugaacaccuucaccaacauggaggcccagcucauccggcagauggagggggagggcaucuucaaguccauccagcaccugacggugaccgaggagaucgccguccagaacuggcuggcgcgcgugggccgggagcgccucagccggauggccaucuccggggacgacugcguggucaagccccuggacgaccgcuucgccagcgcccugaccgcccucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucgggcgggcgcgcaucucccagggcgccggcuggagccugaaggagacggccugccuggggaaguccuacgcccagauguggacccucauguacuuccaccggcgcgaccugcggcuggccgcgaacgccaucugcagcgccgugcccucccacugggugcccaccagccgcaccaccugguccauccacgccaagcacgaguggaugacgaccgaggacaugcucgcggucuggaaccggguguggauccaggagaacccguggauggaggacaagacccccguggagagcugggaggagguccccuaccugggcaagcgcgaggaccaguggugcgggagccugaucggccucaccucccgcgccacgugggccaagaacauccagaccgccaucaaccaggugcggagccugaucgggaacgaggaguacaccgacuacaugcccuccaugaagcgcuuccggcgcgaggaggaggaggccggcgugcugugguga

SEQ ID NO: 9378 - RNA, 9876 nt, Artificial Sequence
  derived and/or modified CDS sequence (opt1) from DENV-2__EU482572__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccucgagaaccugauguggaagcaggucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccggcgacugcggcaaccgggggcccagccuccgcacgaccaccgccagcggcaagcugaucaccgaguggugcugccgguccugcacgcugcccccgcuccgcuaccgcggggaggacggcugcugguacgggauggagauccgcccccugaaggagaaggaggagaaccuggugaacagccucgugaccgccggccacggccagaucgacaacuucucccuggggguccugggcauggcccucuuccuggaggagaugcugcggacccgcguggggaccaagcacgcgauccuccugguggccgucagcuucgugacgcugaucaccggcaacauguccuuccgggaccucgggcgcgugauggucauggugggcgccaccaugaccgacgacaucggcaugggggugacguaccuggcccugcucgccgcguucaagguccgccccaccuucgccgccggccugcugcuccggaagcugaccagcaaggagcugaugauggccaccaucgggaucgcccuccugucccagagcacgauccccgagaccauccuggagcucaccgacgcgcuggcccugggcaugauggugcucaagaucgugcgcaacauggagaaguaccagcuggccgucaccaucauggccaucuccugcgugccgaacgccgugauccugcagaacgcguggaaggucagcugcacgauccucgccguggucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccaucauggccguggggauggucagcauccuggccuccagccugcucaagaacgacauccccaugaccggcccccugguggccgggggccugcucacggugugcuacguccugaccgggcggagcgcggaccuggagcucgagcgcgccgccgacgugaagugggaggaccaggccgagaucuccggcagcucccccauccugagcaucaccaucuccgaggacggcagcauguccaucaagaacgaggaggaggagcagacccugacgauccucauccggaccgggcugcuggugaucagcggcgucuucccgguguccauccccaucaccgccgcggccugguaccucugggaggugaagaagcagcgcgccgggguccugugggacgugcccagcccgccgcccgugggcaaggccgagcuggaggacggggccuaccggaucaagcagcgcggcauccucggcuacucccagaucggggcgggcgucuacaaggaggggaccuuccacaccauguggcacgugacgcggggcgccgugcugaugcaccgcgggaagcggaucgagcccagcugggccgacgucaagaaggaccugaucuccuacggcggcggguggaagcucgagggcgaguggaaggagggggaggagguccaggugcuggcccuggagcccggcaagaacccccgcgccguccagaccaagcccggccuguucaagaccaacaccggcacgaucggcgcggugagccuggacuucucccccgggaccagcggcucccccaucguggaccggaaggggaaggucgugggccuguacggcaacgggguggucacccgcagcggcgccuacguguccgccaucgcccagaccgagaaguccaucgaggacaaccccgagaucgaggacgacaucuuccggaagaagcgccucacgaucauggaccugcaccccggggcgggcaagaccaagcgguaccugcccgccaucgugcgcgaggccaucaagcgggggcugcgcacccucauccuggccccgacccgcgucguggccgcggagauggaggaggcccugcggggccuccccauccgcuaccagacgcccgccauccgggccgagcacaccggccgcgagaucguggaccugaugugccacgccaccuucaccaugcggcugcucagccccguccgcgugccgaacuacaaccugaucaucauggacgaggcgcacuucacggaccccgccuccaucgccgcccggggguacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucacggacuucaagggcaagaccgugugguucgugccguccaucaaggccggcaacgacaucgcggccugccugcgcaagaacgggaagaaggucauccagcucagccggaagaccuucgacuccgaguacgugaagacccgcgccaacgacugggacuucguggucacgaccgacaucagcgagaugggcgccaacuucaaggccgagcgggugaucgacccccgccggugcaugaagcccgugauccugaccgacggggaggagcgcgucauccuggcgggccccaugccggugacccacuccagcgccgcccagcggcgcgggcgcaucggccggaaccccaagaacgagaacgaccaguacaucuacaugggcgagccccucgagaacgacgaggacugcgcccacuggaaggaggccaagaugcugcuggacaacaucaacacgcccgaggggaucaucccguccauguucgagcccgagcgcgagaagguggacgcgaucgacggcgaguaccggcuccgcggggaggcccggaagaccuucgucgaccugaugcgccggggcgaccugcccguguggcucgccuaccgcguggccgccgaggggaucaacuacgcggaccggcgcuggugcuucgacggcaucaagaacaaccagauccuggaggagaacgucgagguggagaucuggaccaaggagggcgagcggaagaagcugaagccgcgcuggcucgacgcccggaucuacagcgacccccuggcccugaaggaguucaaggaguucgccgcggggcgcaagucccucacccugaaccugaucacggagaugggccggcuccccaccuucaugacccagaaggcccgcgacgcccuggacaaccuggccguccuccacaccgccgaggccggcgggaaggccuacaaccacgcccugagcgagcugcccgagacgcucgagacccugcugcuccugacccugcucgccaccgugacgggcgggaucuuccuguuccugauguccgggaaggggaucggcaagaugacccucgggaugugcugcaucaucaccgccagcauccugcugugguacgcgcagauccagccgcacuggaucgccgccuccaucauccucgaguucuuccugaucgugcugcucauccccgagcccgagaagcagcggacgccccaggacaaccagcugaccuacgucgugaucgccauccugacgguggucgccgcgaccauggccaacgagaugggcuuccucgagaagaccaagaaggaccugggccuggggagcaucaccacgcaggagagcgaguccaacauccucgacaucgaccugcgcccggccagcgccuggacccuguacgccguggcgaccaccuucgugacgcccaugcuccggcacuccaucgagaacagcuccgucaacgugagccugaccgccaucgccaaccaggccaccgugcugaugggccucgggaagggcuggccccuguccaagauggacaucggggucccccugcucgcgaucggcugcuacagccaggugaacccgaucacccugacggccgcccugcuccugcugguggcccacuacgccaucaucggccccgggcuccaggcgaaggccacccgcgaggcccagaagcgggccgccgcgggcaucaugaagaaccccaccgucgacgggaucaccgugaucgaccuggagcccaucccguacgaccccaaguucgagaagcagcugggccaggugaugcuccugauccugugcgucacccaggugaugaugaugcgcaccaccugggcccucugcgaggcccugacccuggccacggggcccaucuccacccucugggagggcaaccccggccgcuucuggaacaccaccaucgccgugagcauggcgaacaucuuccggggguccuaccuggccggcgccgggcuccucuucagcaucaugaagaacacgaccaacacccgccggggcaccggcaacaucggggagacgcugggcgagaaguggaagucccgccugaacgcccucggcaagagcgaguuccagaucuacaagaaguccggcauccaggaggucgaccggacccuggcgaaggaggggaucaagcgcggcgagaccgaccaccacgccgugagccggggcuccgccaagcugcgcugguucguggagcggaacauggucaccccggaggggaaggugguggaccucggcugcgggcgcggcggguggagcuacuacugcggcggccugaagaacguccgggaggugaaggggcugacgaagggcgggcccggccacgaggagcccauccccauguccaccuacggguggaaccucgugcgccugcagagcggcgucgacguguucuucaccccgcccgagaagugcgacacccugcucugcgacaucggcgagagcucccccaaccccacgaucgaggccgggcggacccugcgcgugcugaaccucgucgagaacuggcugaacaacaacacccaguucugcaucaaggugcugaacccguacaugcccagcgugaucgagaagauggagacccuccagcggaaguacggcggggcccugguccgcaacccccugucccggaacagcacccacgagauguacuggguguccaacgcgacgggcaacaucgugagcuccgucaacaugaucagccgcaugcugaucaaccgguucaccaugaagcacaagaaggccaccuacgagccggacguggaccucggguccggcacccgcaacaucggcaucgagagcgagauccccaaccuggacaucaucgggaagcgcaucgagaagaucaagcaggagcacgagacguccuggcacuacgaccaggaccaccccuacaagaccugggccuaccacggcagcuacgaggccaagcagaccggguccgccagcuccauggugaacggcgucgugcggcugcucaccaagcccugggacguggucccgauggugacgcagauggcgaugaccgacaccacccccuucggccagcagcgcguguucaaggagaaggucgacacgcggacccaggagcccaaggaggggaccaagaagcugaugaagaucaccgccgaguggcuguggaaggagcucggcaagaagaagacgccccgcaugugcacccgggaggaguucacccgcaaggugcggagcaacgccgcccugggggccaucuucaccgacgagaacaaguggaaguccgcgcgcgaggccguggaggacagccgguucugggagcuggucgaccgcgagcggaaccuccaccuggagggcaagugcgagacgugcguguacaacaugauggggaagcgcgagaagaagcugggcgaguucggcaaggccaaggggucccgggccaucugguacauguggcucggcgcgcgcuuccuggaguucgaggcccugggguuccucaacgaggaccacugguucagccggggcaacagccuguccggggucgagggcgagggccugcaccgccucggguacauccugcgggacgugagcaagaaggagggcggggccauguacgccgacgacaccgccggcugggacacccgcaucacccuggaggaccucaagaacgaggagauggugacgaaccacaugaagggggagcacaagaagcuggcggaggccaucuucaagcugaccuaccagaacaaggucgugcgggugcagcgcccgacgccccggggcaccgucauggacaucaucucccgccgcgaccagcggggcagcggccagguggggacguacgggcucaacaccuucaccaacauggaggcccagcugauccgccagauggagggcgagggcaucuucaaguccauccagcaccugaccgugacggaggagaucgccguccagaacuggcucgcccggguggggcgcgagcggcugagccgcauggugaucuccggcgacgacugcgucgugaagccccuggacgaccgguucgcgagcgcccucaccgcccugaacgacauggggaaggugcgcaaggacauccagcagugggagcccucccggggcuggaacgacuggacccaggucccguucugcagccaccacuuccacgagcuggugaugaaggacgggcgcgugcucgucgugcccugccggaaccaggacgagcugaucggccgcgcccggaucucccagggcgccggguggagccugaaggagaccgcgugccucggcaaguccuacgcccagauguggacgcugauguacuuccaccgccgggaccugcgccucgccgccaacgccaucugcagcgcggugcccucccacuggguccccaccagccggaccaccugguccauccacgccaagcacgaguggaugaccacggaggacaugcuggccguguggaaccgcguguggauccaggagaacccguggauggaggacaagacccccgucgagagcugggaggaggugcccuaccuggggaagcgggaggaccaguggugcggcagccucaucgggcugaccucccgcgccaccugggcgaagaacauccagacggccaucaaccaggugcgcagccugaucggcaacgaggaguacaccgacuacaugcccuccaugaagcgguuccgccgggaggaggaggaggccggcguccucugguga

SEQ ID NO: 9379 - RNA, 9876 nt, Artificial Sequence
  derived and/or modified CDS sequence (opt1) from DENV-2__EU482573__SS-prME
accgccggcgugaucaucaugcugauccccaccgccauggcguuccaccucaccacccggaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggcgaagaugcugagcacggagucccacaaccagaccuuccucaucgacgggcccgagaccgccgagugcccgaacaccaaccgggccuggaacagccuggagguggaggacuacggcuucggggucuucacgaccaacaucuggcugaagcuccgcgagaagcaggacguguucugcgacuccaagcugaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccgcccgggcuaccacacccagacggcggggcccuggcaccugggcaagcucgagauggacuucgacuucugcgaggggaccaccgucguggugaccgaggacugcggcaaccggggccccagccugcgcacgaccaccgccagcgggaagcugaucaccgaguggugcugccgguccugcacgcugccgccccugcgcuaccggggcgaggacgggugcugguacggcauggagauccgcccccugaaggagaaggaggagaaccucgucaacagccuggugaccgccgggcacggccagaucgacaacuucucccugggcgugcucgggauggcccuguuccuggaggagaugcuccggacccgcgucggcaccaagcacgcgauccugcugguggccgugagcuucgucacgcucaucaccgggaacauguccuuccgggaccugggccgcgugauggugauggucggggccaccaugaccgacgacaucggcaugggcgugacguaccuggcccuccuggccgcguucaaggugcgccccaccuucgccgccgggcugcuccugcggaagcugaccagcaaggagcucaugauggccaccaucggcaucgcccugcugucccagagcacgauccccgagaccauccucgagcugaccgacgcgcuggcccucgggaugaugguccugaagaucgugcgcaacauggagaaguaccagcuggccgugaccaucauggccaucuccugcguccccaacgccgugauccuccagaacgcguggaaggugagcugcacgauccuggccgccgucuccgugagcccccugcuccugaccuccagccagcagaaggccgacuggaucccccuggcgcucaccaucaagggccugaaccccaccgccaucuuccugacgacccucucccggaccagcaagaagcgcuccuggccgcugaacgaggccaucauggccgucggcauggugagcauccuggccuccagccuccugaagaacgacauccccaugaccgggccccugguggcgggcgggcuccugacggucugcuacgugcugaccggccggagcgccgaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgucaucagcgggguguucccgguguccauccccaucaccgcggccgccugguaccugugggaggucaagaagcagcgcgccggcgugcugugggacgugcccuccccgccgcccgucgggaaggccgagcucgaggacggcgcguaccggaucaagcagcgcgggauccugggcuacucccagaucggcgccgggguguacaaggagggcaccuuccacaccauguggcacgugacgcgcggggccguccugaugcaccgcggcaagcggaucgagcccagcugggccgacgugaagaaggaccucaucuccuacgggggcggcuggaagcuggagggggaguggaaggagggcgaggaggugcagguccuggcccucgagcccgggaagaacccccgcgcggugcagaccaagcccggccuguucaagaccaacaccgggacgaucggcgccgugagccuggacuucucccccggcaccagcgggucccccaucgucgaccggaagggcaaggugguggggcucuacggcaacggcgucgugacccgcagcggggccuacguguccgccaucgcgcagaccgagaaguccaucgaggacaaccccgagaucgaggacgacaucuuccggaagaagcgccugacgaucauggaccugcaccccggcgccgggaagaccaagcgguaccugcccgccaucguccgcgaggccaucaagcggggccuccgcacccugauccuggccccgacccgcgugguggcggccgagauggaggaggcccuccgggggcugcccauccgcuaccagacgcccgccauccgggccgagcacaccggccgcgagaucgucgaccugaugugccacgcgaccuucaccaugcggcuccugagccccgugcgcgugccgaacuacaaccugaucaucauggacgaggcccacuucacggaccccgccuccaucgccgcccggggcuacaucagcacccgcgucgagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggcgggcaacgacaucgccgccugccuccgcaagaacggcaagaaggugauccagcugagccggaagaccuucgacuccgaguacgugaagacccgcgccaacgacugggacuucgucgugacgaccgacaucagcgagaugggggccaacuucaaggcggagcgggugaucgacccccgccggugcaugaagcccgucauccugaccgacggcgaggagcgcgugauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuaccgcgucgccgcggagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucacggagauggggcggcugcccaccuucaugacccagaaggcccgcgacgcccuggacaaccucgccguccugcacaccgcggaggccggcgggcgggccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucguccuccugauccccgagcccgagaagcagcgcacgccccaggacaaccagcugaccuacguggugaucgccauccucacggucguggcggccaccauggccaacgagaugggguuccuggagaagaccaagaaggaccugggccucggcagcaucaccacgcaggagagcgaguccaacauccuggacaucgaccugcggccggccagcgccuggacccucuacgcgguggccaccaccuucgucacgcccaugcugcgccacuccaucgagaacagcuccgugaacgugagccugaccgccaucgccaaccaggcgaccguccucauggggcugggcaagggguggccccuguccaagauggacaucggcgugccccuccuggccaucgggugcuacagccaggugaacccgaucacccugacggccgcccuccugcugcucgucgcccacuacgcgaucaucggccccggccugcaggccaaggccacccgggaggcccagaagcgcgccgcggccgggaucaugaagaaccccaccguggacggcaucaccgugaucgaccuggagcccaucccguacgaccccaaguucgagaagcagcucgggcaggucaugcugcugauccucugcgugacccaggugcugaugaugcgcaccaccugggcccugugcgaggcccucacccuggccacgggccccaucuccacccugugggaggggaaccccggccgguucuggaacaccaccaucgcggucagcauggccaacaucuuccgcggcuccuaccucgccggggccggccugcuguucagcaucaugaagaacacgaccaacacccggcgcgggaccggcaacaucggcgagacgcucggggagaaguggaagucccggcugaacgcgcugggcaagagcgaguuccagaucuacaagaaguccgggauccaggagguggaccgcacccucgccaaggagggcaucaagcgcggggagaccgaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugacgaagggcggccccgggcacgaggagcccauccccauguccaccuacggcuggaaccugguccggcuccagagcgggguggacguguucuucaccccgcccgagaagugcgacacccugcugugcgacaucggcgagagcucccccaaccccacgaucgaggccggccgcacccuccggguccugaaccugguggagaacuggcucaacaacaacacccaguucugcaucaaggugcugaacccguacaugcccagcgucaucgagaagauggagacccugcagcgcaaguacgggggcgcgcuggugcggaacccccucucccgcaacagcacccacgagauguacuggguguccaacgccacggggaacaucgucagcuccgugaacaugaucagccggaugcugaucaaccgcuucaccaugaagcacaagaaggccaccuacgagccggacguggaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccugcugacgaagcccugggacgucgugccgauggugacccagauggcgaugaccgacaccacgcccuucggccagcagcgggucuucaaggagaagguggacacccgcacccaggagcccaaggagggcaccaagaagcucaugaagaucacggccgaguggcuguggaaggagcuggggaagaagaagacgccccggaugugcacccgcgaggaguucacccggaaggugcgcagcaacgccgcccucggcgccaucuucacggacgagaacaaguggaaguccgcgcgggaggccgucgaggacagccgcuucugggagcugaucgaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgucagcaagaaggagggcggcgccauguacgccgacgacaccgccgggugggacacccggaucacgcuggaggaccugaagaacgaggagauggugaccaaccacaugaagggcgagcacaagaagcucgcggaggccaucuucaagcugaccuaccagaacaaggucgugcgcgugcagcggccgacgccccgcgggaccgucauggacaucaucucccgccgggaccagcgcggcagcggccagguggggaccuacggccugaacaccuucaccaacauggaggcccagcucauccggcagauggagggggagggcaucuucaaguccauccagcaccugacggugaccgaggagaucgccguccagaacuggcuggcccgcgugggccgggagcgccucagccggauggcgaucuccggggacgacugcguggucaagccccuggacgaccgcuucgccagcgcccugaccgcccucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucgggcgggcccgcaucucccagggcgcgggcuggagccugaaggagacggccugccuggggaaguccuacgcccagauguggacccucauguacuuccaccggcgcgaccugcggcuggccgccaacgcgaucugcagcgccgugcccucccacugggugcccaccagccgcaccaccugguccauccacgccaagcacgaguggaugacgaccgaggacaugcucgccgucuggaaccggguguggauccaggagaacccguggauggaggacaagacccccguggagagcugggaggagguccccuaccugggcaagcgcgaggaccaguggugcgggagccugaucggccucaccucccgcgcgacgugggccaagaacauccagaccgccaucaaccaggugcggagccugaucgggaacgaggaguacaccgacuacaugcccuccaugaagcgcuuccggcgcgaggaggaggaggccggcgugcugugguga

SEQ ID NO: 9380 - RNA, 9876 nt, Artificial Sequence
  derived and/or modified CDS sequence (opt1) from DENV-2__EU482574__SS-prME
accgccggcgugaucaucaugcugauccccaccgccauggcguuccaccucaccacccggaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcacauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggcgaagaugcugagcacggagucccacaaccagaccuuccucaucgacgggcccgagaccgccgagugcccgaacaccaaccgggccuggaacagccuggagguggaggacuacggcuucggggucuucacgaccaacaucuggcugaagcuccgcgagaagcaggacguguucugcgacuccaagcugaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccgcccgggcuaccacacccagacggcggggcccuggcaccugggcaagcucgagauggacuucgacuucugcgaggggaccaccgucguggugaccgaggacugcggcaaccggggccccagccugcgcacgaccaccgccagcgggaagcugaucaccgaguggugcugccgguccugcacgcugccgccccugcgcuaccggggcgaggacgggugcugguacggcauggagauccgcccccugaaggagaaggaggagaaccucgucaacagccuggugaccgccgggcacggccagaucgacaacuucucccugggcgugcucgggauggcccuguuccuggaggagaugcuccggacccgcgucggcaccaagcacgcgauccugcugguggccgugagcuucgucacgcucaucaccgggaacauguccuuccgggaccugggccgcgugauggugauggucggggccaccaugaccgacgacaucggcaugggcgugacguaccuggcccuccuggccgcguucaaggugcgccccaccuucgccgccgggcugcuccugcggaagcugaccagcaaggagcucaugauggccaccaucggcaucgcccugcugucccagagcacgauccccgagaccauccucgagcugaccgacgcgcuggcccucgggaugaugguccugaagaucgugcgcaacauggagaaguaccagcuggccgugaccaucauggccaucuccugcguccccaacgccgugauccuccagaacgcguggaaggugagcugcacgauccuggccgccgucuccgugagcccccugcuccugaccuccagccagcagaaggccgacuggaucccccuggcgcucaccaucaagggccugaaccccaccgccaucuuccugacgacccucucccggaccagcaagaagcgcuccuggccgcugaacgaggccaucauggccgucggcauggugagcauccuggccuccagccuccugaagaacgacauccccaugaccgggccccugguggcgggcgggcuccugacggucugcuacgugcugaccggccggagcgccgaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgucaucagcgggguguucccgguguccauccccaucaccgcggccgccugguaccugugggaggucaagaagcagcgcgccggcgugcugugggacgugcccuccccgccgcccgucgggaaggccgagcucgaggacggcgcguaccggaucaagcagcgcgggauccugggcuacucccagaucggcgccgggguguacaaggagggcaccuuccacaccauguggcacgugacgcgcggggccguccugaugcaccgcggcaagcggaucgagcccagcugggccgacgugaagaaggaccucaucuccuacgggggcggcuggaagcuggagggggaguggaaggagggcgaggaggugcagguccuggcccucgagcccgggaagaacccccgcgcggugcagaccaagcccggccuguucaagaccaacaccgggacgaucggcgccgugagccuggacuucucccccggcaccagcgggucccccaucgucgaccggaagggcaaggugguggggcucuacggcaacggcgucgugacccgcagcggggccuacguguccgccaucgcgcagaccgagaaguccaucgaggacaaccccgagaucgaggacgacaucuuccggaagaagcgccugacgaucauggaccugcaccccggcgccgggaagaccaagcgguaccugcccgccaucguccgcgaggccaucaagcggggccuccgcacccugauccuggccccgacccgcgugguggcggccgagauggaggaggcccuccgggggcugcccauccgcuaccagacgcccgccauccgggccgagcacaccggccgcgagaucgucgaccugaugugccacgcgaccuucaccaugcggcuccugagccccgugcgcgugccgaacuacaaccugaucaucauggacgaggcccacuucacggaccccgccuccaucgccgcccggggcuacaucagcacccgcgucgagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggcgggcaacgacaucgccgccugccuccgcaagaacggcaagaaggugauccagcugagccggaagaccuucgacuccgaguacgugaagacccgcgccaacgacugggacuucgucgugacgaccgacaucagcgagaugggggccaacuucaaggcggagcgggugaucgacccccgccggugcaugaagcccgucauccugaccgacggcgaggagcgcgugauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuaccgcgucgccgcggagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucacggagauggggcggcugcccaccuucaugacccagaaggcccgcgacgcccuggacaaccucgccguccugcacaccgcggaggccggcgggcgggccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucguccuccugauccccgagcccgagaagcagcgcacgccccaggacaaccagcugaccuacguggugaucgccauccucacggucguggcggccaccauggccaacgagaugggguuccuggagaagaccaagaaggaccugggccucggcagcaucaccacgcaggagagcgaguccaacauccuggacaucgaccugcggccggccagcgccuggacccucuacgcgguggccaccaccuucgucacgcccaugcugcgccacuccaucgagaacagcuccgugaacgugagccugaccgccaucgccaaccaggcgaccguccucauggggcugggcaagggguggccccuguccaagauggacaucggcgugccccuccuggccaucgggugcuacagccaggugaacccgaucacccugacggccgcccuccugcugcucgucgcccacuacgcgaucaucggccccggccugcaggccaaggccacccgggaggcccagaagcgcgccgcggccgggaucaugaagaaccccaccguggacggcaucaccgugaucgaccuggagcccaucccguacgaccccaaguucgagaagcagcucgggcaggucaugcugcugauccucugcgugacccaggugcugaugaugcgcaccaccugggcccugugcgaggcccucacccuggccacgggccccaucuccacccugugggaggggaaccccggccgguucuggaacaccaccaucgcggucagcauggccaacaucuuccgcggcuccuaccucgccggggccggccugcuguucagcaucaugaagaacacgaccaacacccggcgcgggaccggcaacaucggcgagacgcucggggagaaguggaagucccggcugaacgcgcugggcaagagcgaguuccagaucuacaagaaguccgggauccaggagguggaccgcacccucgccaaggagggcaucaagcgcggggagaccgaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugacgaagggcggccccgggcacgaggagcccauccccauguccaccuacggcuggaaccugguccggcuccagagcgggguggacguguucuucaccccgcccgagaagugcgacacccugcugugcgacaucggcgagagcucccccaaccccacgaucgaggccggccgcacccuccggguccugaaccugguggagaacuggcucaacaacaacacccaguucugcaucaaggugcugaacccguacaugcccagcgucaucgagaagauggagacccugcagcgcaaguacgggggcgcgcuggugcggaacccccucucccgcaacagcacccacgagauguacuggguguccaacgccacggggaacaucgucagcuccgugaacaugaucagccggaugcugaucaaccgcuucaccaugaagcacaagaaggccaccuacgagccggacguggaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccugcugacgaagcccugggacgucgugccgauggugacccagauggcgaugaccgacaccacgcccuucggccagcagcgggucuucaaggagaagguggacacccgcacccaggagcccaaggagggcaccaagaagcucaugaagaucacggccgaguggcuguggaaggagcuggggaagaagaagacgccccggaugugcacccgcgaggaguucacccggaaggugcgcagcaacgccgcccucggcgccaucuucacggacgagaacaaguggaaguccgcgcgggaggccgucgaggacagccgcuucugggagcugaucgaccgggagcgcaaccugcaccucgaggggaagugcgagaccugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgucagcaagaaggagggcggcgccauguacgccgacgacaccgccgggugggacacccggaucacgcuggaggaccugaagaacgaggagauggugaccaaccacaugaagggcgagcacaagaagcucgcggaggccaucuucaagcugaccuaccagaacaaggucgugcgcgugcagcggccgacgccccgcgggaccgucauggacaucaucucccgccgggaccagcgcggcagcggccagguggggaccuacggccugaacaccuucaccaacauggaggcccagcucauccggcagauggagggggagggcaucuucaaguccauccagcaccugacggugaccgaggagaucgccguccagaacuggcuggcccgcgugggccgggagcgccucagccggauggcgaucuccggggacgacugcguggucaagccccuggacgaccgcuucgccagcgcccugaccgcccucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucgggcgggcccgcaucucccagggcgcgggcuggagccugaaggagacggccugccuggggaaguccuacgcccagauguggacccucauguacuuccaccggcgcgaccugcggcuggccgccaacgcgaucugcagcgccgugcccucccacugggugcccaccagccgcaccaccugguccauccacgccaagcacgaguggaugacgaccgaggacaugcucgccgucuggaaccggguguggauccaggagaacccguggauggaggacaagacccccguggagagcugggaggagguccccuaccugggcaagcgcgaggaccaguggugcgggagccugaucggccucaccucccgcgcgacgugggccaagaacauccagaccgccaucaaccaggugcggagccugaucgggaacgaggaguacaccgacuacaugcccuccaugaagcgcuuccggcgcgaggaggaggaggccggcgugcugugguga

SEQ ID NO: 9381 - RNA, 9876 nt, Artificial Sequence
  derived and/or modified CDS sequence (opt1) from DENV-2__EU482575__SS-prME
accgccggcgugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcggcgccgggagaagcgcuccgucgcccuggugccccacguggggaugggccucgagacccggaccgagaccuggaugagcagcgagggggccuggaagcacguccagcgcaucgagacguggauccugcggcacccgggcuucaccaucauggccgcgauccuggccuacaccaucgggaccacgcacuuccagcgcgcccucaucuucauccugcugaccgccguggcgcccagcaugaccaugcggugcaucggcaucuccaaccgcgacuucguggagggcgucagcgggggcuccuggguggacaucgugcucgagcacgggagcugcgucaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguuccucugcaagcacuccaugguggaccgcggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccgccagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccggcugcgcauggacaagcugcagcucaaggggauguccuacagcaugugcaccggcaaguucaagaucgucaaggagaucgccgagacccagcacgggacgaucgugauccgggugcaguacgagggcgacggcucccccugcaagauccccuucgagaucauggaccuggagaagcgccacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcggggcgccaagcgcauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgguccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccgcagcgucacccggcuggagaaccugauguggaagcagaucacccccgagcucaaccacauccuguccgagaacgaggugaagcugacgaucaugaccggcgacaucaaggggaucaugcaggccggcaagcgcagccuccggccgcagcccaccgagcugaaguacuccuggaagaccuggggcaaggcgaagaugcugagcacggagucccacaaccagaccuuccucaucgacgggcccgagaccgccgagugcccgaacaccaaccgcgccuggaacagccuggagguggaggacuacggcuucggggucuucuccacgaacaucuggcugaagcuccgggagaagcaggacguguucugcgacagcaagcugauguccgccgccaucaaggacaaccgcgcggugcacgccgacaugggcuacuggaucgagagcgcccugaacgacaccuggaagauggagaaggccuccuucaucgaggucaagagcugccacuggcccaagucccacacccucuggagcaacggcgugcuggaguccgagaugaucauccccaagaacuucgccgggcccgugagccagcacaacuaccggccgggcuaccacacccagaccgcggggcccuggcaccugggcaagcucgagauggacuucgacuucugcgaggggacgaccgucguggugaccgaggacugcggcaaccgcggccccagccugcggaccacgaccgccuccgggaagcugaucaccgaguggugcugccgcagcugcacccugccgccccugcgguaccgcggcgaggacgggugcugguacggcauggagauccggccccugaaggagaaggaggagaaccucgucaacucccuggugacggccgggcacggccagaucgacaacuucagccugggcgugcucgggauggcccuguuccuggaggagaugcuccgcacccgggucggcaccaagcacgcgauccugcugguggccguguccuucgucacccucaucacggggaacaugagcuuccgcgaccugggccgcgugauggugauggucggggccaccaugaccgacgacaucggcaugggcgugaccuaccuggcccuccuggccgcguucaaggugcggcccacguucgccgccgggcugcuccugcgcaagcugaccuccaaggagcucaugauggccaccaucggcaucgcccugcugagccaguccaccauccccgagacgauccucgagcugaccgacgcgcuggcccucgggaugaugguccugaagaucgugcggaacauggagaaguaccagcuggccgugaccaucauggccaucagcugcguccccaacgccgugauccuccagaacgcguggaagguguccugcaccauccuggccgccgucagcgugagcccccugcuccugacgagcucccagcagaaggccgacuggaucccccuggcgcucaccaucaagggccugaaccccaccgccaucuuccugaccacgcucagccgcaccuccaagaagcggagcuggccgcugaacgaggccaucauggccgucggcaugguguccauccuggccagcagccuccugaagaacgacauccccaugaccgggccccugguggcgggcgggcuccugaccgucugcuacgugcugacgggccgcuccgccgaccucgagcuggagcgggccgccgacgugaagugggaggaccaggccgagaucagcggguccagccccauccuguccaucaccaucagcgaggacggcuccaugagcaucaagaacgaggaggaggagcagacccucaccauccugauccgcacgggccugcucgucaucuccgggguguucccggugagcauccccaucaccgcggccgccugguaccugugggaggucaagaagcagcgggccggcgugcugugggacgugcccagcccgccgcccgucgggaaggccgagcucgaggacggcgcguaccgcaucaagcagcgggggauccugggcuacagccagaucggcgccgggguguacaaggagggcaccuuccacaccauguggcacgugacccgcggggccguccugaugcaccggggcaagcgcaucgagcccuccugggccgacgugaagaaggaccucaucagcuacgggggcggcuggaagcuggagggggaguggaaggagggcgaggaggugcagguccuggcccucgagcccgggaagaacccccgggcggugcagacgaagcccggccuguucaagaccaacaccgggaccaucggcgccgugucccuggacuucagccccggcacguccgggagccccaucgucgaccgcaagggcaaggugguggggcucuacggcaacggcgucgugacccgguccggggccuacgugagcgccaucgcgcagaccgagaaguccaucgaggacaaccccgagaucgaggacgacaucuuccgcaagaagcggcugaccaucauggaccugcaccccggcgccgggaagacgaagcgcuaccugcccgccaucguccgggaggccaucaagcgcggccuccgcacccugauccuggccccgacccgggugguggcggccgagauggaggaggcccuccgcgggcugcccauccgguaccagacccccgccauccgcgccgagcacacgggccgggagaucgucgaccugaugugccacgcgaccuucaccaugcgccuccugucccccgugcgggugccgaacuacaaccugaucaucauggacgaggcccacuucaccgaccccgccagcaucgccgcccgcggcuacaucuccacgcgggucgagaugggggaggcggccggcaucuucaugaccgccacgccgcccgggagccgcgacccguucccccaguccaacgcccccaucauggacgaggagcgggagauccccgagcgcagcuggaacuccggccacgagugggugaccgacuucaaggggaagacggugugguucgucccgagcaucaaggcgggcaacgacaucgccgccugccuccggaagaacggcaagaaggugauccagcugucccgcaagaccuucgacagcgaguacgugaagacccgggccaacgacugggacuucgucgugaccacggacaucuccgagaugggggccaacuucaaggcggagcgcgugaucgacccccggcgcugcaugaagcccgucauccugaccgacggcgaggagcgggugauccucgccgggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggcgaagaugcugcucgacaacaucaacacccccgagggcaucaucccgagcauguucgagcccgagcgggagaaggucgacgccaucgacggggaguaccgccugcggggcgaggcccgcaagacguucguggaccugaugcggcgcggggaccuccccguguggcuggccuaccgggucgccgcggagggcaucaacuacgccgaccgccgguggugcuucgacgggaucaagaacaaccagauccuggaggagaacguggagguggagaucuggaccaaggagggcgagcgcaagaagcucaagccgcgguggcuggacgcccgcaucuacuccgacccccuggcccucaaggaguucaaggaguucgcggccggccgcaagagccugacccugaaccucaucaccgagauggggcggcugcccacguucaugacccagaaggcccgggacgcccuggacaaccucgccguccugcacaccgcggaggccggcgggcgcgccuacaaccacgcccuguccgagcuccccgagacccuggagacgcugcuccugcugacccuccuggccaccgugaccggcggcaucuuccuguuccucaugagcgggaagggcaucgggaagaugacgcugggcaugugcugcaucaucaccgcguccauccugcucugguacgcccagauccagccgcacuggaucgccgccagcaucauccuggaguucuuccugaucguccuccugauccccgagcccgagaagcagcggacgccccaggacaaccagcugaccuacguggugaucgccauccucaccgucguggcggccacgauggccaacgagaugggguuccuggagaagaccaagaaggaccugggccucggcagcaucaccacccaggaguccgagagcaacauccuggacaucgaccugcgcccggccuccgccuggacgcucuacgcgguggccaccaccuucgucacccccaugcugcggcacagcaucgagaacuccagcgugaacgugucccugacggccaucgccaaccaggcgaccguccucauggggcugggcaagggguggccccugagcaagauggacaucggcgugccccuccuggccaucgggugcuacucccaggugaacccgaucacccugaccgccgcccuccugcugcucgucgcccacuacgcgaucaucggccccggccugcaggccaaggccacgcgcgaggcccagaagcgcgccgcggccgggaucaugaagaaccccaccguggacggcaucaccgugaucgaccuggagcccaucccguacgaccccaaguucgagaagcagcucgggcaggucaugcugcugauccucugcgugacccaggugcugaugaugcggacgaccugggcccugugcgaggcccucacccuggccaccggccccaucagcacgcugugggaggggaaccccggccgcuucuggaacaccaccaucgcggucuccauggccaacaucuuccggggcagcuaccucgccggggccggccugcuguucuccaucaugaagaacaccacgaacacccgccgggggaccggcaacaucggcgagacccucggggagaaguggaagucccgccugaacgcgcugggcaaguccgaguuccagaucuacaagaaguccgggauccaggagguggaccggacgcucgccaaggagggcaucaagcgcggggagaccgaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugaccaagggcgggcccgggcacgaggagcccauccccaugagcacguacggcuggaaccugguccgccuccagagcgggguggacguguucuucaccccgcccgagaagugcgacacccugcugugcgacaucggcgaguccagccccaaccccaccaucgaggccggccggacgcuccgcguccugaaccugguggagaacuggcucaacaacaacacccaguucugcaucaaggugcugaacccguacaugcccuccgucaucgagaagauggagacccugcagcggaaguacgggggcgcgcuggugcgcaacccccucagccggaacuccacccacgagauguacugggugagcaacgccaccgggaacaucgucuccagcgugaacaugaucucccgcaugcugaucaaccgcuucacgaugaagcacaagaaggccaccuacgagccggacguggaccugggcagcgggacccggaacaucggcaucgaguccgagauccccaaccucgacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggucaacgggguggugcggcugcugaccaagcccugggacgucgugccgauggugacgcagauggcgaugaccgacaccacccccuucggccagcagcgcgucuucaaggagaagguggacacgcggacccaggagcccaaggagggcaccaagaagcucaugaagaucaccgccgaguggcuguggaaggagcuggggaagaagaagacgccccgcaugugcacccgggaggaguucacccgcaaggugcgguccaacgccgcccucggcgccaucuucaccgacgagaacaaguggaaguccgcgcgcgaggccgucgaggacucccgguucugggagcugaucgaccgcgagcggaaccugcaccucgaggggaagugcgagacgugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucagccgggggaacucccucagcggcguggagggggagggccugcaccgccugggcuacauccuccgggacgucuccaagaaggagggcggcgccauguacgccgacgacaccgccgggugggacacccgcaucacccuggaggaccugaagaacgaggagauggugacgaaccacaugaagggcgagcacaagaagcucgcggaggccaucuucaagcugaccuaccagaacaaggucgugcgggugcagcgcccgacgccccgcgggaccgucauggacaucaucagccggcgcgaccagcggggcuccggccagguggggaccuacggccugaacaccuucaccaacauggaggcccagcucauccgccagauggagggggagggcaucuucaagagcauccagcaccugaccgugacggaggagaucgccguccagaacuggcuggcccgggugggccgcgagcggcucucccgcauggcgaucagcggggacgacugcguggucaagccccuggacgaccgguucgccuccgcccugaccgcccucaacgacaugggcaaggugcgcaaggacauccagcagugggagcccagccggggguggaacgacuggacccaggugccguucugcucccaccacuuccacgagcuggucaugaaggacggccgcgugcuggugguccccugccggaaccaggacgagcucaucgggcgcgcccggaucagccagggcgcgggcuggucccugaaggagaccgccugccugggcaagagcuacgcccagauguggacgcucauguacuuccaccgccgggaccugcgccuggccgccaacgcgaucugcuccgccgugcccagccacugggugcccaccucccggaccaccuggagcauccacgccaagcacgaguggaugaccacggaggacaugcucgccgucuggaaccgcguguggauccaggagaacccguggauggaggacaagacccccguggagagcugggaggagguccccuaccugggcaagcgcgaggaccaguggugcgggucccugaucggccucaccagccgggcgaccugggccaagaacauccagacggccaucaaccaggugcgcucccugaucgggaacgaggaguacaccgacuacaugcccagcaugaagcgguuccgccgggaggaggaggaggccggcgugcugugguga

SEQ ID NO: 9382 - RNA, 9876 nt, Artificial Sequence
  derived and/or modified CDS sequence (opt1) from DENV-2__EU482578__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaaguccaaggagcugaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccagaccuuccugaucgacgggcccgagaccgccgagugcccgaacaccaaccgggccuggaacucccucgaggucgaggacuacggcuucgggguguucacgaccaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacccgcgugggcaccaagcacgcgauccuccugguggccgucuccuucgugacgcugaucaccgggaacaugagcuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccuccaaggagcugaugauggccaccaucggcaucgcccuccugagccaguccacgauccccgagaccauccuggagcucaccgacgcgcuggcccuggggaugauggugcucaagaucgugcgcaacauggagaaguaccagcuggccgucaccaucauggccaucagcugcgugccgaacgccgugauccugcagaacgcguggaaggucuccugcacgauccucgccgccgugagcgucagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccgugggcaugguguccauccuggccagcagccugcucaagaacgacauccccaugaccgggccccuggucgcgggcgggcugcucacggugugcuacgugcugaccggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugacgauccucauccggaccggccugcuggugaucuccgggguguucccggucagcauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacagccagaucggcgccgggguguacaaggagggcaccuuccacaccauguggcacgucacgcgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagaccaagcccggccucuucaagaccaacaccgggacgaucggcgccgucucccuggacuucagccccggcaccuccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucacgaucauggaccugcaccccggcgccgggaagaccaagcgguaccugcccgccaucgugcgcgaggccaucaagcggggccugcgcacccucauccuggccccgacccgcguggucgcggccgagauggaggaggcccugcgggggcuccccauccgcuaccagacgcccgccauccgggccgagcacaccggccgcgagaucguggaccugaugugccacgcgaccuucaccaugcggcugcucucccccgugcgcgucccgaacuacaaccugaucaucauggacgaggcccacuucacggaccccgccagcaucgccgcccggggcuacaucuccacccgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugacgaccgacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacgcccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucacggagauggggcggcuccccaccuucaugacccagaaggcccgcgacgcccuggacaaccuggccgugcuccacaccgcggaggccggcgggcgggccuacaaccacgcccuguccgagcugcccgagacgcucgagacccugcugcuccugacccugcucgccaccgucacgggcggcaucuuccuguuccugaugagcgggaagggcaucgggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugacggugguggcggccaccauggccaacgagaugggguuccucgagaagaccaagaaggaccugggccugggcagcaucaccacgcaggaguccgagagcaacauccucgacaucgaccugcggccggccuccgccuggacccuguacgcggucgccaccaccuucgugacgcccaugcuccgccacagcaucgagaacuccagcgugaacgucucccugaccgccaucgccaaccaggcgaccgugcugauggggcucggcaagggguggccccugagcaagauggacaucggcgugccccugcucgccaucgggugcuacucccaggucaacccgaucacccugacggccgcccugcuccugcugguggcccacuacgcgaucaucggccccggccuccaggccaaggccacccgggaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacgcagguccucaugaugcgcaccaccugggcccugugcgaggcccugacccucgccacgggccccaucagcacccugugggaggggaaccccggccgguucuggaacaccaccaucgcgguguccauggccaacaucuuccgcggcagcuaccuggccggggccggccuccuguucuccaucaugaagaacacgaccaacacccggcgcgggaccggcaacaucggcgagacgcugggggagaaguggaagucccggcucaacgcgcugggcaaguccgaguuccagaucuacaagaaguccgggauccaggagguggaccgcacccuggccaaggagggcaucaagcgcggggagaccgaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucacgaagggcgggcccgggcacgaggagcccauccccaugagcaccuacggcuggaaccuggugcggcugcagagcgggguggacgucuucuucaccccgcccgagaagugcgacacccuccugugcgacaucggcgaguccagccccaaccccacgaucgaggccggccgcacccugcgggugcucaaccugguggagaacuggcugaacaacaacacccaguucugcaucaagguccucaacccguacaugcccuccgugaucgagaagauggagacccugcagcgcaaguacgggggcgcgcuggugcggaacccccugagccgcaacuccacccacgagauguacugggucagcaacgccacggggaacaucguguccagcgugaacaugaucucccggaugcucaucaaccgcuucaccaugaagcacaagaaggccaccuacgagccggacgucgaccugggcagcgggacccgcaacaucggcaucgaguccgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgccuccagcauggugaacggggugguccgccuccugacgaagcccugggacguggugccgauggucacccagauggcgaugaccgacaccacgcccuucggccagcagcggguguucaaggagaagguggacacccgcacccaggagcccaaggagggcaccaagaagcugaugaagaucacggccgaguggcucuggaaggagcuggggaagaagaagacgccccggaugugcacccgcgaggaguucacccggaagguccgcuccaacgccgcccugggcgccaucuucacggacgagaacaaguggaaguccgcgcgggaggccguggaggacucccgcuucugggagcucaucgaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgccgacgacaccgccgggugggacacccggaucacgcucgaggaccugaagaacgaggagauggucaccaaccacaugaagggcgagcacaagaagcuggcggaggccaucuucaagcucaccuaccagaacaagguggugcgcguccagcggccgacgccccgggggacggugauggacaucaucagccgccgggaccagcgcggcuccggccagguggggaccuacggccugaacaccuucaccaacauggaggcccagcugauccggcagauggagggggagggcaucuucaagagcauccagcaccucacggucaccgaggagaucgccgugcagaacuggcuggcccgcgugggccgggagcgccugucccggauggcgaucagcggggacgacugcgucgugaagccccucgacgaccgcuucgccuccgcccugaccgcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucgggcgggcccgcaucagccagggcgcgggcuggucccucaaggagacggccugccugggcaagagcuacgcccagauguggacccugauguacuuccaccggcgcgaccuccggcuggccgccaacgcgaucugcuccgccgugcccagccacuggguccccaccucccgcaccaccuggagcauccacgccaagcacgaguggaugacgaccgaggacaugcuggccguguggaaccggguguggauccaggagaacccguggauggaggacaagacccccgucgagagcugggaggaggugcccuaccucggcaagcgcgaggaccaguggugcgggucccugaucggccugaccagccgcgcgacgugggccaagaacauccagaccgccaucaaccaggugcggucccucaucgggaacgaggaguacaccgacuacaugcccagcaugaagcgcuuccggcgcgaggaggaggaggccggcguccugugguga

SEQ ID NO: 9383 - RNA, 9876 nt, Artificial Sequence
  derived and/or modified CDS sequence (opt1) from DENV-2__EU482580__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagaucuucaucggcgugaucaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugaugguccugaagaucgugcgcaacauggagaaguaccagcucgccgugaccaucauggccaucuccugcgucccgaacgccgugauccugcagaacgcguggaaggugagcugcacgauccuggccgccgucuccgugagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgucggcauggugagcauccucgccuccagccugcugaagaacgacauccccaugaccgggccccucguggcgggcgggcugcugacggucugcuacgugcucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacccugacgauccugauccggaccggccuccuggucaucagcgggguguucccgguguccauccccaucaccgcggccgccugguaccugugggaggucaagaagcagcgcgccggcgugcucugggacgugcccagcccgccgcccgucgggaaggccgagcuggaggacggcgcguaccggaucaagcagcgcgggauccugggcuacucccagaucggcgccgggguguacaaggagggcaccuuccacaccauguggcacgugacgcgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgcggugcagaccaagcccggccuguucaagaccaacaccgggacgaucggcgccgugagccucgacuucucccccggcaccagcgggucccccaucgucgaccggaagggcaaggugguggggcuguacggcaacggcgucgugacccgcagcggggccuacguguccgccaucgcgcagaccgagaaguccaucgaggacaaccccgagaucgaggacgacaucuuccggaagaagcgccugacgaucauggaccuccaccccggcgccgggaagaccaagcgguaccugcccgccaucguccgcgaggccaucaagcggggccugcgcacccugauccucgccccgacccgcgugguggcggccgagauggaggaggcccugcgggggcugcccauccgcuaccagacgcccgccauccgggccgagcacaccggccgcgagaucgucgaccucaugugccacgcgaccuucaccaugcggcugcugagccccgugcgcgugccgaacuacaaccucaucaucauggacgaggcccacuucacggaccccgccuccaucgccgcccggggcuacaucagcacccgcgucgagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggcgggcaacgacaucgccgccugccugcgcaagaacggcaagaaggugauccagcugagccggaagaccuucgacuccgaguacgugaagacccgcgccaacgacugggacuucgucgugacgaccgacaucagcgagaugggggccaacuucaaggcggagcgggugaucgacccccgccggugcaugaagcccgucauccucaccgacggcgaggagcgcgugauccuggccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgcgagaaggucgacgccaucgacggggaguaccggcugcgcggcgaggcccggaagaccuucguggaccucaugcgccgcggggaccugcccguguggcuggccuaccgcgucgccgcggagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacagcgacccccucgcccugaaggaguucaaggaguucgcggccggccgcaagucccugacccucaaccugaucacggagauggggcggcugcccaccuucaugacccagaaggcccgcgacgcccucgacaaccuggccguccugcacaccgcggaggccggcgggaaggccuacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgcgagcauccuccugugguacgcccagauccagccgcacuggaucgccgccuccaucauccuggaguucuuccucaucguccugcugauccccgagcccgagaagcagcggacgccccaggacaaccagcucaccuacguggugaucgccauccugacggucguggcggccaccauggccaacgagaugggguuccuggagaagaccaagaaggaccucggccugggcagcaucaccacgcaggagagcgaguccaacauccuggacaucgaccuccgcccggccagcgccuggacccuguacgcgguggccaccaccuucgucacgcccaugcugcggcacuccaucgagaacagcuccgugaacgugagccucaccgccaucgccaaccaggcgaccguccugauggggcugggcaagggguggccccucuccaagauggacaucggcgugccccugcuggccaucgggugcuacagccaggugaacccgaucacccucacggccgcccugcugcuccuggucgcccacuacgcgaucaucggccccggccugcaggccaaggccacccgcgaggcccagaagcgggccgcggccgggaucaugaagaaccccaccguggacggcaucaccgugaucgaccucgagcccaucccguacgaccccaaguucgagaagcagcuggggcaggucaugcugcucauccugugcgugacccaggugcugaugaugcgcaccaccugggcccucugcgaggcccugacccuggccacgggccccaucuccacccucugggaggggaaccccggccgcuucuggaacaccaccaucgcggucagcauggccaacaucuuccggggcuccuaccuggccggggccggccuccuguucagcaucaugaagaacacgaccaacacccgccgggggaccggcaacaucggcgagacgcugggggagaaguggaagucccgccugaacgcgcucggcaagagcgaguuccagaucuacaagaaguccgggauccaggagguggaccggacccuggccaaggagggcaucaagcgcggggagaccgaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugacgaagggcgggcccgggcacgaggagcccauccccauguccaccuacggcuggaaccucguccgccugcagagcgggguggacguguucuucaccccgcccgagaagugcgacacccugcucugcgacaucggcgagagcucccccaaccccacgaucgaggccggccggacccugcgcguccugaaccucguggagaacuggcugaacaacaacacccaguucugcaucaaggugcugaacccguacaugcccagcgucaucgagaagauggagacccuccagcggaaguacgggggcgcgcuggugcgcaacccccugucccggaacagcacccacgagauguacuggguguccaacgccacggggaacaucgucagcuccgugaacaugaucagccgcaugcugaucaaccgguucaccaugaagcacaagaaggccaccuacgagccggacguggaccucggcuccgggacccgcaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggucaacgggguggugcggcugcucacgaagcccugggacgucgugccgauggugacccagauggcgaugaccgacaccacgcccuucggccagcagcgcgucuucaaggagaagguggacacccggacccaggagcccaaggagggcaccaagaagcugaugaagaucacggccgaguggcuguggaaggagcucgggaagaagaagacgccccggaugugcacccgggaggaguucacccgcaaggugcggagcaacgccgcccugggcgccaucuucacggacgagaacaaguggaaguccgcgcgcgaggccgucgaggacagccgguucugggagcugguggaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcgucgagggggagggccugcaccgccucggcuacauccugcgggacgugagcaagaaggagggcggcgccauguacgccgacgacaccgccgggugggacacccgcaucacgcuggaggaccucaagaacgaggagauggucaccaaccacaugaagggcgagcacaagaagcuggcggaggccaucuucaagcugaccuaccagaacaagguggugcggguccagcgcccgacgccccgggggacggugauggacaucaucucccgccgcgaccagcggggcagcggccagguggggaccuacggccucaacaccuucaccaacauggaggcccagcugauccgccagauggagggggagggcaucuucaaguccauccagcaccugacggucaccgaggagaucgccgugcagaacuggcucgcccgggugggccgcgagcggcugagccgcauggcgaucuccggggacgacugcgucgugaagccccuggacgaccgguucgccagcgcccucaccgcccugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgcgggcuggagccugaaggagacggccugccucgggaaguccuacgcccagauguggacccugauguacuuccaccgccgggaccugcgccucgccgccaacgcgaucugcagcgccgugcccucccacuggguccccaccagccggaccaccugguccauccacgccaagcacgaguggaugacgaccgaggacaugcuggccguguggaaccgcguguggauccaggagaacccguggauggaggacaagacccccgucgagagcugggaggaggugcccuaccugggcaagcgggaggaccaguggugcgggagccucaucggccugaccucccgcgcgacgugggccaagaacauccagaccgccaucaaccaggugcgcagccugaucgggaacgaggaguacaccgacuacaugcccuccaugaagcgguuccgccgggaggaggaggaggccggcguccucugguga

SEQ ID NO: 9384 - RNA, 9876 nt, Artificial Sequence
  derived and/or modified CDS sequence (opt1) from DENV-2__EU482581__SS-prME
accgcgggcgucaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccggcaaggacagccccgugaacaucgaggcggagccgcccuucggggacuccuacaucaucaucggcguggagccggggcagcucaagcugaacugguucaagaagggcagcuccaucggccagauguucgagaccacgaugcgcggggccaagcggauggccauccugggcgacaccgccugggacuucgggagccucggcggggucuucaccuccaucggcaaggcccugcaccagguguucggcgcgaucuacggggccgccuucagcggcguguccuggaccaugaagauccugaucggggucaucaucacguggaucggcaugaacagccgcuccaccagccuguccgugagccucgugcuggucgggguggugacccuguaccucggcgccaugguccaggcggacuccggcugcguggugagcuggaaguccaaggagcugaagugcgggagcggcaucuucaucaccgacaacguccacacguggaccgagcaguacaaguuccagcccgagagccccuccaagcuggccagcgccauccagaaggcccacgaggaggggaucugcggcauccgguccgugacccgccucgagaaccugauguggaagcagaucacccccgagcugaaccacauccucagcgagaacgaggugaagcugacgaucaugaccggggacaucaagggcaucaugcaggccggcaagcggucccugcgcccgcagcccaccgagcucaaguacagcuggaagaccugggggaaggcgaagaugcuguccacggagagccacaaccagaccuuccugaucgacggccccgagaccgccgagugcccgaacaccaaccgggccuggaacucccucgaggucgaggacuacggguucggcguguucacgaccaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggggugcucgaguccgagaugaucauccccaagaacuucgccggccccgugagccagcacaacuaccgcccgggguaccacacccagacggcgggccccuggcaccuggggaagcuggagauggacuucgacuucugcgagggcaccaccgugguggucaccgaggacugcggcaaccgggggcccagccuccgcacgaccaccgccuccggcaagcugaucaccgaguggugcugccggagcugcacgcugcccccgcuccgcuaccgcggggaggacggcugcugguacgggauggagauccgcccccugaaggagaaggaggagaaccuggugaacucccucgugaccgccggccacggccagaucgacaacuucagccuggggguccugggcauggcccucuuccuggaggagaugcugcggacccgcguggggaccaagcacgcgauccuccugguggccgucuccuucgugacgcugaucaccggcaacaugagcuuccgggaccucgggcgcgugauggucauggugggcgccaccaugaccgacgacaucggcaugggggugacguaccuggcccugcucgccgcguucaagguccgccccaccuucgccgccggccugcugcuccggaagcugaccuccaaggagcugaugauggccaccaucgggaucgcccuccugagccaguccacgauccccgagaccauccuggagcucaccgacgcgcuggcccugggcaugauggugcucaagaucgugcgcaacauggagaaguaccagcuggccgucaccaucauggccaucagcugcgugccgaacgccgugauccugcagaacgcguggaaggucuccugcacgauccucgccgccgugagcgucagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccguggggaugguguccauccuggccagcagccugcucaagaacgacauccccaugaccggcccccuggucgccggcgggcugcucacggugugcuacgugcugaccgggcgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugacgauccucauccggaccgggcugcuggugaucuccggcguguucccggucagcauccccaucaccgcggccgccugguaccucugggaggugaagaagcagcgcgccggggugcugugggacguccccagcccgccgcccgugggcaaggccgagcuggaggacggggcguaccggaucaagcagcgcggcauccucggcuacagccagaucggggccggcguguacaaggaggggaccuuccacaccauguggcacgucacgcggggcgccgugcugaugcaccgcgggaagcggaucgagcccuccugggccgacgugaagaaggaccugaucagcuacggcggcggguggaagcucgagggcgaguggaaggagggggaggagguccaggugcuggcccuggagcccggcaagaacccccgcgcggugcagaccaagcccggccucuucaagaccaacaccggcacgaucggcgccgucucccuggacuucagccccgggaccuccggcagccccaucguggaccggaaggggaagguggucggccuguacggcaacgggguggugacccgcuccggcgccuacgucagcgccaucgcgcagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcugcgcacccucauccuggccccgacccgcguggucgcggccgagauggaggaggcccugcggggccuccccauccgcuaccagacgcccgccauccgggccgagcacaccggccgcgagaucguggaccugaugugccacgcgaccuucaccaugcggcugcucucccccgugcgcgucccgaacuacaaccugaucaucauggacgaggcccacuucacggaccccgccagcaucgccgcccggggguacaucuccacccgcguggagaugggcgaggcggccgggaucuucaugaccgccacgccgcccggcagccgggacccguucccccaguccaacgcccccaucauggacgaggagcgcgagauccccgagcggagcuggaacuccgggcacgagugggugacggacuucaagggcaagaccgucugguucgugccgagcaucaaggcgggcaacgacaucgccgccugccugcgcaagaacgggaagaaggugauccagcucucccggaagaccuucgacagcgaguacgucaagacccgcgccaacgacugggacuucguggugacgaccgacaucuccgagaugggcgccaacuucaaggcggagcgggucaucgacccccgccggugcaugaagcccgugauccugaccgacggggaggagcgcgugauccuggccggccccaugccggucacccacagcuccgccgcccagcggcgcgggcgcaucggccggaaccccaagaacgagaacgaccaguacaucuacaugggcgagccccucgagaacgacgaggacugcgcccacuggaaggaggcgaagaugcugcuggacaacaucaacacgcccgaggggaucaucccgagcauguucgagcccgagcgcgagaagguggacgccaucgacggcgaguaccggcuccgcggggaggcccggaagaccuucguggaccugaugcgccggggcgaccugcccgucuggcucgccuaccgcguggccgcggaggggaucaacuacgccgaccggcgcuggugcuucgacggcaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccgggcgcaagagccucacccugaaccugaucacggagaugggccggcuccccaccuucaugacccagaaggcccgcgacgcccuggacaaccuggccgugcuccacaccgcggaggccgggggccgggccuacaaccacgcccuguccgagcugcccgagacgcucgagacccugcugcuccugacccugcucgccaccgucacgggcgggaucuuccuguuccugaugagcggcaaggggaucggcaagaugacccucgggaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugacggugguggcggccaccauggccaacgagaugggcuuccucgagaagaccaagaaggaccugggccuggggagcaucaccacgcaggaguccgagagcaacauccucgacaucgaccugcggccggccuccgccuggacccuguacgcggucgccaccaccuucgugacgcccaugcuccgccacagcaucgagaacuccagcgugaacgucucccugaccgccaucgccaaccaggcgaccgugcugaugggccucgggaagggcuggccccugagcaagauggacaucggggugccccugcucgccaucggcugcuacucccaggucaacccgaucacccugacggccgcccugcuccugcugguggcccacuacgcgaucaucggccccgggcuccaggccaaggccacccgggaggcccagaagcgcgccgcggccggcaucaugaagaaccccaccguggacgggaucaccgucaucgaccuggagcccaucccguacgaccccaaguucgagaagcagcugggccaggugaugcuccugauccugugcgugacgcagguccucaugaugcgcaccaccugggcccugugcgaggcccugacccucgccacggggcccaucagcacccugugggagggcaaccccggccgguucuggaacaccaccaucgcgguguccauggccaacaucuuccgcgggagcuaccuggccggcgccgggcuccuguucuccaucaugaagaacacgaccaacacccggcgcggcaccggcaacaucggggagacgcugggcgagaaguggaagucccggcucaacgcgcuggggaaguccgaguuccagaucuacaagaaguccggcauccaggagguggaccgcacccuggccaaggaggggaucaagcggggcgagaccgaccaccacgccgucucccgcggcagcgccaagcuccggugguucguggagcgcaacauggugaccccggaggggaaggucguggaccugggcugcgggcggggcgggugguccuacuacugcggcggccugaagaacgugcgcgaggucaaggggcucacgaagggcgggcccggccacgaggagcccauccccaugagcaccuacggguggaaccuggugcggcugcagagcggcguggacgucuucuucaccccgcccgagaagugcgacacccuccugugcgacaucggcgaguccagccccaaccccacgaucgaggccgggcgcacccugcgggugcucaaccugguggagaacuggcugaacaacaacacccaguucugcaucaagguccucaacccguacaugcccuccgugaucgagaagauggagacccugcagcgcaaguacggcggggcgcuggugcggaacccccugagccgcaacuccacccacgagauguacugggucagcaacgccacgggcaacaucguguccagcgugaacaugaucucccggaugcucaucaaccgcuucaccaugaagcacaagaaggccaccuacgagccggacgucgaccuggggagcggcacccgcaacaucggcaucgaguccgagauccccaaccuggacaucaucgggaagcggaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccuccugacgaagcccugggacguggugccgauggucacccagauggcgaugaccgacaccacgcccuucggccagcagcggguguucaaggagaagguggacacccgcacccaggagcccaaggaggggaccaagaagcugaugaagaucacggccgaguggcucuggaaggagcugggcaagaagaagacgccccggaugugcacccgcgaggaguucacccggaagguccgcuccaacgccgcccugggggccaucuucacggacgagaacaaguggaaguccgcgcgggaggccguggaggacucccgcuucugggagcucaucgaccgggagcgcaaccugcaccuggagggcaagugcgagaccugcguguacaacaugauggggaagcgggagaagaagcucggcgaguucggcaaggccaaggggagccgcgccaucugguacauguggcugggcgcgcgguuccuggaguucgaggcccucggguuccugaacgaggaccacugguucagccgcggcaacucccugagcggggucgagggcgagggccuccaccggcugggguacauccugcgcgacguguccaagaaggagggcggggccauguacgccgacgacaccgccggcugggacacccggaucacgcucgaggaccugaagaacgaggagauggucaccaaccacaugaagggggagcacaagaagcuggcggaggccaucuucaagcucaccuaccagaacaagguggugcgcguccagcggccgacgccccgcggcacggugauggacaucaucagccgccgggaccagcgcggcuccggccagguggggaccuacgggcugaacaccuucaccaacauggaggcccagcugauccggcagauggagggcgagggcaucuucaagagcauccagcaccucacggucaccgaggagaucgccgugcagaacuggcuggcccgcguggggcgggagcgccugucccggauggcgaucagcggcgacgacugcgucgugaagccccucgacgaccgcuucgccuccgcccugaccgcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcccgcaucagccagggcgcgggguggucccucaaggagacggccugccugggcaagagcuacgcccagauguggacccugauguacuuccaccggcgcgaccuccggcuggccgccaacgcgaucugcuccgccgugcccagccacuggguccccaccucccgcaccaccuggagcauccacgccaagcacgaguggaugacgaccgaggacaugcuggccguguggaaccggguguggauccaggagaacccguggauggaggacaagacccccgucgagagcugggaggaggugcccuaccucgggaagcgcgaggaccaguggugcggcucccugaucgggcugaccagccgcgcgacgugggccaagaacauccagaccgccaucaaccaggugcggucccucaucggcaacgaggaguacaccgacuacaugcccagcaugaagcgcuuccggcgcgaggaggaggaggccggcguccugugguga

SEQ ID NO: 9385 - RNA, 9876 nt, Artificial Sequence
  derived and/or modified CDS sequence (opt1) from DENV-2__EU482582__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcggcacccgggcuucaccaucauggccgcgauccuggccuacaccaucgggaccaaccacuuccagcgggcccucaucuucauccugcugacggccguggcgcccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcggccucuucggcaagggcgggaucgucacgugcgcgauguucacgugcaagaagaacauggagggcaagguggugcugcccgagaaccuggaguacaccaucgucaucacgccccacagcggggaggagcacgccgugggcaacgacacggggaagcacggcaaggagaucaagaucaccccgcaguccagcaucaccgaggccgagcucaccggguacggcaccgugacgauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacccucgugacguucaagaacccccacgcgaagaagcaggacgucgugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgccgagacccagcacgggaccaucgugauccgcguccaguacgagggcgacggcucccccugcaagauccccuucgagaucauggaccucgagaagcggcacgugcuggggcgccugaucacggugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcccugcaccagguguucggcgcgaucuacggcgccguguucagcggggucuccuggaccaugaagauccugaucggcgugaucaucaccuggaucgggaugaacagccgcuccacgagccuguccgugagccucguccuggugggcguggucacccuguaccucggggccauggugcaggccgacuccggcugcguggucagcuggaaguccaaggagcugaagugcggcagcgggaucuucaucaccgacaacgugcacaccuggacggagcaguacaaguuccagcccgagagccccuccaagcuggcgagcgccauccagaaggcccacgaggagggcaucugcgggauccgguccgugacccgccucgagaaccugauguggaagcagaucacccccgagcugaaccacauccucagcgagaacgaggucaagcugaccaucaugacgggcgacaucaaggggaucaugcaggccggcaagcggucccugcgcccgcagcccaccgagcucaaguacagcuggaagaccuggggcaaggccaagaugcuguccaccgagagccacaaccagacguuccugaucgacgggcccgagaccgcggagugcccgaacaccaaccgggccuggaacucccucgagguggaggacuacggcuucgggguguucaccacgaacaucuggcugaagcugcgcgagaagcaggacgucuucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgucacggccgggcacggccagaucgacaacuucagccugggcgugcuggggauggcccucuuccuggaggagaugcugcggacccgcgugggcaccaagcacgccauccuccuggucgcgguguccuucgugacccugaucacggggaacaugagcuuccgggaccucggccgcgucauggugauggugggggccaccaugaccgacgacaucggcaugggcgucaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucguccgcaacauggagaaguaccagcuggccgugaccaucauggccaucagcugcgugccgaacgccgucauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccaucauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggauccucggcuacagccagaucggcgcgggggucuacaaggagggcaccuuccacaccauguggcacgugacccgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugucccuggacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucucccccguccgcgugccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcucucccggaagaccuucgacagcgaguacgugaagacccgcgccaacgacugggacuucguggucaccacggacaucuccgagaugggggccaacuucaaggccgagcgggugaucgacccccgccggugcaugaagcccgugauccugaccgacggcgaggagcgcgucauccuggcggggcccaugccggugacccacagcuccgccgcccagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgcgagaagguggacgcgaucgacggggaguaccggcuccgcggcgaggcccggaagacguucgucgaccugaugcgccgcggggaccugcccguguggcucgccuaccgcguggccgccgagggcaucaacuacgcggaccggcgcuggugcuucgacgggaucaagaacaaccagauccuggaggagaacgucgagguggagaucuggaccaaggagggcgagcggaagaagcugaagccgcgcuggcucgacgcccggaucuacuccgacccccuggcccugaaggaguucaaggaguucgccgcgggccgcaagagccucacccugaaccugaucaccgagauggggcggcuccccacguucaugacccagaaggcccgcgacgcccuggacaaccuggccguccuccacaccgccgaggcgggcgggcgggccuacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcgcagauccagccgcacuggaucgccgccagcaucauccucgaguucuuccugaucgugcugcucauccccgagcccgagaagcagcgcacgccccaggacaaccagcugaccuacgucgugaucgccauccugaccguggucgccgcgacgauggccaacgagaugggguuccucgagaagaccaagaaggaccugggccugggcagcaccaccacgcaggaguccgagagcaacauccucgacaucgaccugcggccggccuccgccuggacccuguacgccguggcgaccaccuucgugacgcccaugcuccgccacagcaucgagaacuccagcgucaacgugucccugaccgccaucgccaaccaggccaccgugcugauggggcucggcaagggguggccccugagcaagauggacaucggcgucccccugcucgcgaucgggugcuacucccaggugaacccgaucacccugacggccgcccugcuccugcugguggcccacuacgccaucaucggccccggccuccaggcgaaggccacccgggaggcccagaagcgcgccgccgcggggaucaugaagaaccccaccgucgacggcaucaccgugaucgaccuggagcccaucccguacgaccccaaguucgagaagcagcugggccaggugaugcuccugauccugugcgucacccaggugcucaugaugcgcaccaccugggcccugugcgaggcccugacccucgccacgggccccaucagcacccugugggaggggaaccccggccgguucuggaacaccaccaucgccguguccauggcgaacaucuuccgcggcagcuaccuggccggggccggccuccuguucuccaucaugaagaacacgaccaacacccggcgcgggaccggcaacaucggcgagacgcugggggagaaguggaagucccggcucaacgcccugggcaaguccgaguuccagaucuacaagaaguccgggauccaggaggucgaccgcacccuggcgaaggagggcaucaagcgcggggagaccgaccaccacgccgugucccgcggcagcgccaagcuccggugguucguggagcgcaacauggucaccccggagggcaaggugguggaccuggggugcggccgcggcgggugguccuacuacugcggcgggcugaagaacguccgcgaggugaaggggcucacgaagggcgggcccgggcacgaggagcccauccccaugagcaccuacggcuggaaccuggugcggcugcagagcggggucgacguguucuucaccccgcccgagaagugcgacacccuccugugcgacaucggcgaguccagccccaaccccacgaucgaggccggccgcacccugcgggugcucaaccuggucgagaacuggcugaacaacaacacccaguucugcaucaaggugcucaacccguacaugcccuccgugaucgagaagauggagacccugcagcgcaaguacgggggcgcccugguccggaacccccugagccgcaacuccacccacgagauguacugggugagcaacgcgacggggaacaucguguccaccgucaacaugaucagccggaugcucaucaaccgcuucaccaugaagcacaagaaggccaccuacgagccggacguggaccugggcuccgggacgcgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggucgugcgccuccugaccaagcccugggacguggucccgauggugacccagauggccaugaccgacacgacccccuucggccagcagcggguguucaaggagaaggucgacacccgcacccaggagcccaaggagggcacgaagaagcugaugaagaucaccgcggaguggcucuggaaggagcuggggaagaagaagacgccccggaugugcacccgcgaggaguucacgcggaaggugcgcagcaacgccgcccugggcgccaucuucaccgacgagaacaaguggaaguccgcccgggaggcgguggaggacagccgcuucugggagcucaucgaccgggagcgcaaccugcaccuggaggggaagugcgagaccugcgucuacaacaugaugggcaagcgggagaagaagcucggggaguucggcaaggccaagggcucccgcgccaucugguacauguggcugggggcccgguuccuggaguucgaggcgcucggcuuccugaacgaggaccacugguucagccgcgggaacagccuguccggcguggagggggagggccuccaccggcugggcuacauccugcgcgacgucagcaagaaggagggcggggccauguacgccgacgacaccgccgggugggacacgcggaucacccucgaggaccugaagaacgaggagauggugaccaaccacaugaagggcgagcacaagaagcuggccgaggcgaucuucaagcucaccuaccagaacaaggugguccgcgugcagcggccgacgccccgcgggaccgugauggacaucaucucccgccgggaccagcgcggcagcggccaggucgggaccuacggccugaacaccuucacgaacauggaggcccagcugauccggcagauggagggggagggcaucuucaaguccauccagcaccucaccgugaccgaggagaucgccgugcagaacuggcuggcccgcgucggccgggagcgccugagccggauggccaucuccggggacgacugcguggugaagccccucgacgaccgcuucgcgagcgcccugaccgcccugaacgacaugggcaagguccggaaggacauccagcagugggagcccucccgcggguggaacgacuggacccaggugccguucugcagccaccacuuccacgagcucgugaugaaggacggccggguccugguggugcccugccgcaaccaggacgagcugaucgggcgggcccgcaucucccagggcgccggcuggagccucaaggagaccgcgugccuggggaaguccuacgcccagauguggacccugauguacuuccaccggcgcgaccuccggcuggccgccaacgccaucugcagcgcgguccccucccacugggugcccaccagccgcaccacgugguccauccacgccaagcacgaguggaugaccaccgaggacaugcuggccguguggaaccgggucuggauccaggagaacccguggauggaggacaagacccccguggagagcugggaggaggugcccuaccucggcaagcgcgaggaccaguggugcgggagccugaucggccugacgucccgcgccaccugggcgaagaacauccagaccgccaucaaccagguccggagccucaucgggaacgaggaguacaccgacuacaugcccuccaugaagcgcuuccggcgcgaggaggaggaggccggcgugcugugguga

SEQ ID NO: 9386 - RNA, 9876 nt, Artificial Sequence
  derived and/or modified CDS sequence (opt1) from DENV-2__EU482583__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaagaacaaggagcugaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucaccaucauggccaucuccugcgugccgaacgccgugauccugcagaacgcguggaaggucagcugcacgauccucgccgccguguccgucagcccccugcugcucaccuccagccagcagaaggccgacuggaucccccuggcgcugaccaucaagggccucaaccccaccgccaucuuccugacgacccugucccggaccagcaagaagcgcuccuggccgcucaacgaggccaucauggccgugggcauggugagcauccuggccuccagccugcucaagaacgacauccccaugaccgggccccuggucgcgggcgggcugcucacggugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacccugacgauccucauccggaccggccugcuggugaucagcgggguguucccggucuccauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacucccagaucggcgccgggguguacaaggagggcaccuuccacaccauguggcacgucacgcgcggggccgugcugaugcaccgcggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgcggugcagaccaagcccggccucuucaagaccaacaccgggacgaucggcgccgucagccuggacuucucccccggcaccagcgggucccccaucguggaccggaagggcaagguggucgggcuguacggcaacggcguggugacccgcagcggggccuacgucuccgccaucgcgcagaccgagaaguccaucgaggacaaccccgagaucgaggacgacaucuuccggaagaagcgccucacgaucauggaccugcaccccggcgccgggaagaccaagcgguaccugcccgccaucgugcgcgaggccaucaagcggggccugcgcacccucauccuggccccgacccgcguggucgcggccgagauggaggaggcccugcgggggcuccccauccgcuaccagacgcccgccauccgggccgagcacaccggccgcgagaucguggaccugaugugccacgcgaccuucaccaugcggcugcucagccccgugcgcgucccgaacuacaaccugaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggcgggcaacgacaucgccgccugccugcgcaagaacggcaagaaggugauccagcucagccggaagaccuucgacgccgaguacgucaagacccgcgccaacgacugggacuucguggugacgaccgacaucuccgagaugggggcgaacuucaaggccgagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacgcccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuaccgcguggcggccgagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcgcugaaggaguucaaggaguucgccgccggccgcaagagccucacccugaaccugaucacggagauggggcggcuccccaccuucaugacccagaaggcccgcgacgcccuggacaaccuggcggugcuccacaccgccgaggccggcgggcgggccuacaaccacgcccuguccgagcugcccgagacgcucgagacccugcugcuccugacccugcucgcgaccgucacgggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgcgauccugacggugguggccgccaccauggccaacgagaugggguuccucgagaagaccaagaaggaccugggccugggcuccaucaccacgcaggagagcgagagcaacauccucgacaucgaccugcggccggccuccgcguggacccuguacgccgucgccaccaccuucgugacgcccaugcuccgccacagcaucgagaacuccagcgugaacgucucccugaccgccaucgcgaaccaggccaccgugcugauggggcucggcaagggguggccccugagcaagauggacaucggcgugccccugcucgccaucgggugcuacucccaggucaacccgaucacccugacggccgcccugcuccugcugguggcgcacuacgccaucaucggccccggccuccaggccaaggccacccgggaggcccagaagcgcgcggccgccgggaucaugaagaaccccaccguggacggcaucaccgucaucgaccuggagcccaucccguacgaccccaaguucgagaagcagcuggggcaggucaugcuccugauccugugcgugacgcagguccucaugaugcgcaccaccugggcccugugcgaggcccugacccucgcgacgggccccaucagcacccugugggaggggaaccccggccgguucuggaacaccaccaucgccguguccauggccaacaucuuccgcggcagcuaccuggccggggcgggccuccuguucuccaucaugaagaacacgaccaacacccggcgcgggaccggcaacaucggcgagacgcugggggagaaguggaagucccggcucaacgcccugggcaaguccgaguuccagaucuacaagaaguccgggauccaggagguggaccgcacccuggccaaggagggcaucaagcgcggggagaccgaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucacgaagggcgggcccgggcacgaggagcccauccccaugagcaccuacggcuggaaccuggugcggcugcaguccgggguggacgucuucuucaccccgcccgagaagugcgacacccuccugugcgacaucggcgagagcagccccaaccccacgaucgaggcgggccgcacccugcgggugcucaaccugguggagaacuggcugaacaacaacacccaguucugcaucaagguccucaacccguacaugcccuccgugaucgagaagauggagacccugcagcgcaaguacgggggcgcccuggugcggaacccccugagccgcaacuccacccacgagauguacugggucagcaacgccacggggaacaucguguccagcgugaacaugaucucccggaugcucaucaaccgcuucaccaugaagcacaagaaggccaccuacgagccggacgucgaccugggcagcgggacccgcaacaucggcaucgaguccgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgcguccagcauggugaacggggugguccgccuccugacgaagcccugggacguggugccgauggucacccagauggccaugaccgacaccacgcccuucggccagcagcggguguucaaggagaagguggacacccgcacccaggagcccaaggagggcaccaagaagcugaugaagaucacggccgaguggcucuggaaggagcuggggaagaagaagacgccccggaugugcacccgcgaggaguucacccggaagguccgcuccaacgccgcccugggcgcgaucuucacggacgagaacaaguggaaguccgcccgggaggccguggaggacucccgcuucugggagcucaucgaccgggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucucccgcgggaacagccugagcggcgucgagggggagggccuccaccggcugggcuacauccugcgcgacguguccaagaaggagggcggggccauguacgccgacgacaccgcggggugggacacccggaucacgcucgaggaccugaagaacgaggagauggucaccaaccacaugaagggcgagcacaagaagcuggccgaggccaucuucaagcucaccuaccagaacaagguggugcgcguccagcggccgacgccccgggggacggugauggacaucaucagccgccgggaccagcgcggcuccggccagguggggaccuacggccugaacaccuucaccaacauggaggcccagcugauccggcagauggagggggagggcaucuucaagagcauccagcaccucacggucaccgaggagaucgccgugcagaacuggcuggcgcgcgugggccgggagcgccugucccggauggccaucagcggggacgacugcgucgugaagccccucgacgaccgcuucgccuccgcccugaccgcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucgggcgggcgcgcaucagccagggcgccggcuggucccucaaggagacggccugccugggcaagagcuacgcccagauguggacccugauguacuuccaccggcgcgaccuccggcuggccgcgaacgccaucugcuccgccgugcccagccacuggguccccaccucccgcaccaccuggagcauccacgccaagcacgaguggaugacgaccgaggacaugcuggcgguguggaaccggguguggauccaggagaacccguggauggaggacaagacccccgucgaguccugggaggaggugcccuaccucggcaagcgcgaggaccaguggugcgggagccugaucggccugaccagccgcgccacgugggccaagaacauccagaccgccaucaaccaggugcggucccucaucgggaacgaggaguacaccgacuacaugcccagcaugaagcgcuuccggcgcgaggaggaggaggccggcguccugugguga

SEQ ID NO: 9387 - RNA, 9876 nt, Artificial Sequence
  derived and/or modified CDS sequence (opt1) from DENV-2__EU482585__SS-prME
accgcgggcgugaucaucaugcugauccccaccgccaucgcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaaguccaaggagcugaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgggaucaagggcaucaugcaggccggcaagcggucccugcgcccgcagcccaccgagcucaaguacagcuggaagaccugggggaaggcgaagaugcuguccacggagagccacaaccagaccuuccugaucgacggccccgagaccgccgagugcccgaacaccaaccgggccuggaacucccucgaggucgaggacuacggguucggcguguucacgaccaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggggugcucgaguccgagauggugauccccaagaacuucgccggccccgugagccagcacaacuaccgcccgggguaccacacccagacggcgggccccuggcaccuggggaagcuggagauggacuucgacuucugcgagggcaccaccguggucgugaccgaggacugcggcaaccgggggcccagccuccgcacgaccaccgccuccggcaagcugaucaccgaguggugcugccggagcugcacgcugcccccgcuccgcuaccgcggggaggacggcugcugguacgggauggagauccgcccccugaaggagaaggaggagaaccuggugaacucccucgucaccgccggccacggccagaucgacaacuucagccugggggugcugggcauggcccucuuccuggaggagaugcugcggacccgcguggggaccaagcacgcgauccuccuggucgccguguccuucgugacgcugaucaccggcaacaugagcuuccgggaccucgggcgcgucauggugauggugggcgccaccaugaccgacgacaucggcaugggggucacguaccuggcccugcucgccgcguucaaggugcgccccaccuucgccgccggccugcugcuccggaagcugaccuccaaggagcugaugauggccaccaucgggaucgcccuccugagccaguccacgauccccgagaccauccuggagcucaccgacgcgcuggcccugggcaugauggugcucaagaucguccgcaacauggagaaguaccagcuggccgugaccaucauggccaucagcugcgugccgaacgccgucauccugcagaacgcguggaagguguccugcacgauccucgccgccgucagcgugagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccguggggauggucuccauccuggccagcagccugcucaagaacgacauccccaugaccggcccccugguggccggcgggcugcucacggugugcuacguccugaccgggcgguccgccgaccuggagcucgagcgcgccgccgacgugaagugggaggaccaggccgagaucagcggguccagccccauccuguccaucaccaucagcgaggacggcuccaugagcaucaagaacgaggaggaggagcagacccugacgauccucauccggaccgggcugcuggugaucuccggcgucuucccggugagcauccccaucaccgcggccgccugguaccucugggaggugaagaagcagcgcgccgggguccugugggacgugcccagcccgccgcccgugggcaaggccgagcuggaggacggggcguaccggaucaagcagcgcggcauccucggcuacagccagaucggggccggcgucuacaaggaggggaccuuccacaccauguggcacgugacgcggggcgccgugcugaugcaccgcgggaagcggaucgagcccuccugggccgacgucaagaaggaccugaucagcuacggcggcggguggaagcucgagggcgaguggaaggagggggaggagguccaggugcuggcccuggagcccggcaagaacccccgcgcgguccagaccaagcccggccucuucaagaccaacaccggcacgaucggcgccgugucccuggacuucagccccgggaccuccggcagccccaucguggaccggaaggggaaggucgugggccuguacggcaacgggguggucacccgcuccggcgccuacgugagcgccaucgcgcagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcugcgcacccucauccuggccccgacccgcgucguggcggccgagauggaggaggcccugcggggccuccccauccgcuaccagacgcccgccauccgggccgagcacaccggccgcgagaucguggaccugaugugccacgcgaccuucaccaugcggcugcucucccccguccgcgugccgaacuacaaccugaucaucauggacgaggcccacuucacggaccccgccagcaucgccgcccggggguacaucuccacccgcguggagaugggcgaggcggccgggaucuucaugaccgccacgccgcccggcagccgggacccguucccccaguccaacgcccccaucauggacgaggagcgcgagauccccgagcggagcuggaacuccgggcacgagugggucacggacuucaagggcaagaccgugugguucgugccgagcaucaaggcgggcaacgacaucgccgccugccugcgcaagaacgggaagaaggucauccagcucucccggaagaccuucgacagcgaguacgugaagacccgcgccaacgacugggacuucguggucacgaccgacaucuccgagaugggcgccaacuucaaggcggagcgggugaucgacccccgccggugcaugaagcccgugauccugaccgacggggaggagcgcgucauccuggccggccccaugccggugacccacagcuccgccgcccagcggcgcgggcgcaucggccggaaccccaagaacgagaacgaccaguacaucuacaugggcgagccccucgagaacgacgaggacugcgcccacuggaaggaggcgaagaugcugcuggacaacaucaacacgcccgaggggaucaucccgagcauguucgagcccgagcgcgagaagguggacgccaucgacggcgaguaccggcuccgcggggaggcccggaagaccuucgucgaccugaugcgccggggcgaccugcccguguggcucgccuaccgcguggccgcggaggggaucaacuacgccgaccggcgcuggugcuucgacggcaucaagaacaaccagauccuggaggagaacgucgagguggagaucuggaccaaggagggcgagcggaagaagcugaagccgcgcuggcucgacgcccggaucuacuccgacccccuggcccugaaggaguucaaggaguucgcggccgggcgcaagagccucacccugaaccugaucacggagaugggccggcuccccaccuucaugacccagaaggcccgcgacgcccuggacaaccuggccguccuccacaccgcggaggccgggggccgggccuacaaccacgcccuguccgagcugcccgagacgcucgagacccugcugcuccugacccugcucgccaccgugacgggcgggaucuuccuguuccugaugagcggcaaggggaucggcaagaugacccucgggaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacgucgugaucgccauccugacgguggucgcggccaccauggccaacgagaugggcuuccucgagaagaccaagaaggaccugggccuggggagcaucaccacgcaggaguccgagagcaacauccucgacaucgaccugcggccggccuccgccuggacccuguacgcgguggccaccaccuucgugacgcccaugcuccgccacagcaucgagaacuccagcgucaacgugucccugaccgccaucgccaaccaggcgaccgugcugaugggccucgggaagggcuggccccugagcaagauggacaucggggucccccugcucgccaucggcugcuacucccaggugaacccgaucacccugacggccgcccugcuccugcugguggcccacuacgcgaucaucggccccgggcuccaggccaaggccacccgggaggcccagaagcgcgccgcggccggcaucaugaagaaccccaccgucgacgggaucaccgugaucgaccuggagcccaucccguacgaccccaaguucgagaagcagcugggccaggugaugcuccugauccugugcgucacccaggugcucaugaugcgcaccaccugggcccugugcgaggcccugacccucgccacggggcccaucagcacccugugggagggcaaccccggccgguucuggaacaccaccaucgcgguguccauggccaacaucuuccgcgggagcuaccuggccggcgccgggcuccuguucuccaucaugaagaacacgaccaacacccggcgcggcaccggcaacaucggggagacgcugggcgagaaguggaagucccggcucaacgcgcuggggaaguccgaguuccagaucuacaagaaguccggcauccaggaggucgaccgcacccuggccaaggaggggaucaagcggggcgagaccgaccaccacgccgugucccgcggcagcgccaagcuccggugguucguggagcgcaacauggucaccccggaggggaaggugguggaccugggcugcgggcggggcgggugguccuacuacugcggcggccugaagaacguccgcgaggugaaggggcucacgaagggcgggcccggccacgaggagcccauccccaugagcaccuacggguggaaccuggugcggcugcagagcggcgucgacguguucuucaccccgcccgagaagugcgacacccuccugugcgacaucggcgaguccagccccaaccccacgaucgaggccgggcgcacccugcgggugcucaaccuggucgagaacuggcugaacuccaacacccaguucugcaucaaggugcucaacccguacaugcccagcgugaucgagaagauggagacccugcagcgcaaguacggcggggcgcugguccggaacccccugucccgcaacagcacccacgagauguacuggguguccaacgccacgggcaacaucgugagcuccgucaacaugaucagccggaugcucaucaaccgcuucaccaugaagcacaagaaggccaccuacgagccggacguggaccugggguccggcacccgcaacaucggcaucgagagcgagauccccaaccuggacaucaucgggaagcggaucgagaagaucaagcaggagcacgagacguccuggcacuacgaccaggaccaccccuacaagaccugggccuaccacggcagcuacgagaccaagcagaccggguccgccagcuccauggugaacggcgucgugcgccuccugacgaagcccugggacguggucccgauggugacccagauggcgaugaccgacaccacgcccuucggccagcagcggguguucaaggagaaggucgacacccgcacccaggagcccaaggaggggaccaagaagcugaugaagaucacggccgaguggcucuggaaggagcugggcaagaagaagacgccccggaugugcacccgcgaggaguucacccggaaggugcgcagcaacgccgcccugggggccaucuucacggacgagaacaaguggaaguccgcgcgggaggccguggaggacagccgcuucugggagcucaucgaccgggagcgcaaccugcaccuggagggcaagugcgagaccugcgucuacaacaugauggggaagcgggagaagaagcucggcgaguucggcaaggccaaggggagccgcgccaucugguacauguggcugggcgcgcgguuccuggaguucgaggcccucggguuccugaacgaggaccacugguucucccgcggcaacagccuguccgggguggagggcgagggccuccaccggcugggguacauccugcgcgacgucagcaagaaggagggcggggccauguacgccgacgacaccgccggcugggacacccggaucacgcucgaggaccugaagaacgaggagauggugaccaaccacaugaagggggagcacaagaagcuggcggaggccaucuucaagcucaccuaccagaacaaggugguccgcgugcagcggccgacgccccgcggcacggugauggacaucaucucccgccgggaccagcgcggcagcgggcaggucggcaccuacgggcugaacaccuucaccaacauggaggcccagcugauccggcagauggagggcgagggcaucuucaaguccauccagcaccucacggugaccgaggagaucgccgugcagaacuggcuggcccgcgucgggcgggagcgccugagccggauggcgaucuccggcgacgacugcguggugaagccccucgacgaccgcuucgccagcgcccugaccgcccugaacgacauggggaagguccggaaggacauccagcagugggagcccucccgcggcuggaacgacuggacccaggugccguucugcagccaccacuuccacgagcucgugaugaaggacgggcggguccugguggugcccugccgcaaccaggacgagcugaucggccgggcccgcaucucccagggcgcgggguggagccucaaggagacggccugccugggcaaguccuacgcccagauguggacccugauguacuuccaccggcgcgaccuccggcuggccgccaacgcgaucugcagcgccguccccucccacugggugcccaccagccgcaccaccuggagcauccacgccaagcacgaguggaugacgaccgaggacaugcuggccguguggaaccgggucuggauccaggagaacccguggauggaggacaagacccccguggaguccugggaggagauccccuaccucgggaagcgcgaggaccaguggugcggcagccugaucgggcugaccucccgcgcgacgugggccaagaacauccagaccgccaucaaccaggugcggagccucaucggcaacgaggaguacaccgacuacaugcccuccaugaagcgcuuccggcgcgaggaggaggaggccggcguccugugguga

SEQ ID NO: 9388 - RNA, 9876 nt, Artificial Sequence
  derived and/or modified CDS sequence (opt1) from DENV-2__EU482587__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgagguggagcucaccggguacggcacggucaccauggagugcagcccccggaccggccuggacuucaacgagauggugcugcuccagauggaggacaaggccuggcuggugcaccggcagugguuccuggaccucccccugcccuggcugccgggggccgacacccagggcagcaacuggauccagaaggagacgcucgucaccuucaagaacccccacgccaagaagcaggacguggucgugcuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccucgagaagcggcacgugcuggggcgccugaucaccgucaacccgaucgugaccgagaaggacagccccgugaacaucgaggccgagccgcccuucggcgacuccuacaucaucaucggggucgagccgggccagcucaagcugaacugguucaagaaggggagcuccaucggccagauguucgagaccacgaugcgcggcgcgaagcggauggccauccugggggacaccgccugggacuucggcagccucgggggcguguucaccuccaucgggaaggcccugcaccagguguucggcgccaucuacggcgcggccuucagcggggucuccuggaccaugaagauccugaucggcgugaucaucacguggaucgggaugaacagccgcuccaccagccuguccgugagccucguccuggugggcguggucacccuguaccucggggccauggugcaggccgacuccggcugcguggucagcuggaagucccgggagcugaagugcggcagcgggaucuucaucaccgacaacgugcacacguggaccgagcaguacaaguuccagcccgagagccccuccaagcuggcgagcgccauccagaaggcccacgaggagggcaucugcgggauccgcuccgugacccggcucgagaaccugauguggaagcagaucacccccgagcugaaccacauccucagcgagaacgaggucaagcugacgaucaugaccggcgacaucaaggggaucaugcaggccggcaagcgcucccugcggccgcagcccaccgagcucaaguacagcuggaagaccuggggcaaggccaagaugcuguccacggagagccacaaccgcaccuuccugaucgacgggcccgagaccgcggagugcccgaacaccaaccgggccuggaacucccucgagguggaggacuacggcuucgggguguucacgaccaacaucuggcugaagcugcgcgagaagcaggacgucuucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccguggucgugaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcgugggcaccaagcacgccauccuccuggucgcgguguccuucgugacgcugaucaccgggaacaugagcuuccgcgaccucggccgggucauggugauggugggggccaccaugaccgacgacaucggcaugggcgucacguaccuggcccugcucgccgccuucaaggugcgccccaccuucgcggccgggcugcugcuccggaagcugaccuccaaggagcugaugauggccaccaucggcaucgcccuccugagccaguccacgauccccgagaccauccuggagcucaccgacgcccuggcgcuggggaugauggugcucaagaucguccgcaacauggagaaguaccagcuggccgugaccaucauggccaucagcugcgugccgaacgccgucauccugcagaacgccuggaagguguccugcacgauccucgcggccgucagcgugagcccccugcugcucaccagcucccagcagaaggccgacuggaucccccuggcccugaccaucaagggccucaaccccaccgcgaucuuccugacgacccugagccggaccuccaagaagcgcagcuggccgcucaacgaggccaucauggccgugggcauggucuccauccuggccagcagccugcucaagaacgacauccccaugaccgggccccugguggccggcgggcugcucacggugugcuacguccugaccggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugacgauccucauccggaccggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggauccucggcuacagccagaucggcgcgggggucuacaaggagggcaccuuccacaccauguggcacgugacgcgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgccguccagaccaagcccggccucuucaagaccaacaccgggacgaucggcgcggugucccuggacuucagccccggcaccuccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccucacgaucauggaccugcaccccggcgcggggaagaccaagcgguaccugcccgccaucgugcgcgaggccaucaagcgcggccugcggacccucauccuggccccgacccgcgucguggccgcggagauggaggaggcccugcgggggcuccccauccgcuaccagacgcccgccauccgggccgagcacaccggccgcgagaucguggaccugaugugccacgccaccuucaccaugcggcugcucucccccguccgcgugccgaacuacaaccugaucaucauggacgaggcgcacuucacggaccccgccagcaucgccgcccggggcuacaucuccacccgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucacggacuucaaggggaagaccgugugguucgugccgagcaucaaggccggcaacgacaucgcggccugccugcgcaagaacggcaagaaggucauccagcucucccggaagaccuucgacagcgaguacgugaagacccgcgccaacgacugggacuucguggucacgaccgacaucuccgagaugggggccaacuucaaggccgagcgggugaucgacccccgccggugcaugaagcccgugauccugaccgacggcgaggagcgcgucauccuggcggggcccaugccggugacccacagcuccgccgcccagcgccggggccgcaucgggcggaaccccaagaacgagaacgaccaguacaucuacaugggcgagccccucgagaacgacgaggacugcgcccacuggaaggaggccaagaugcugcuggacaacaucaacacgcccgagggcaucaucccgagcauguucgagcccgagcgcgagaagguggacgcgaucgacggggaguaccggcuccgcggcgaggcccggaagaccuucgucgaccugaugcgccgcggggaccugcccguguggcucgccuaccgcguggccgccgagggcaucaacuacgcggaccggcgcuggugcuucgacgggaucaagaacaaccagauccuggaggagaacgucgagguggagaucuggaccaaggagggcgagcggaagaagcugaagccgcgcuggcucgacgcccggaucuacuccgacccccuggcccugaaggaguucaaggaguucgccgcgggccgcaagagccucacccugaaccugaucacggagauggggcggcuccccaccuucaugacccagaaggcccgcgacgcccuggacaaccuggccguccuccacaccgccgaggcgggcgggcgggccuacaaccacgcccuguccgagcugcccgagacgcucgagacccugcugcuccugacccugcucgccaccgugacgggcggcaucuuccuguuccugaugagcgggaagggcaucgggaagaugacccucggcaugugcugcaucaucaccgccuccauccugcugugguacgcgcagauccagccgcacuggaucgccgccagcaucauccucgaguucuuccugaucgugcugcucauccccgagcccgagaagcagcgcacgccccaggacaaccagcugaccuacgucgugaucgccauccugacgguggucgccgcgaccauggccaacgagaugggguuccucgagaagaccaagaaggaccugggccugggcagcaucaccacgcaggaguccgagagcaacauccucgacaucgaccugcggccggccuccgccuggacccuguacgccguggcgaccaccuucgugacgcccaugcuccgccacagcaucgagaacuccagcgucaacgugucccugaccgccaucgccaaccaggccaccgugcugauggggcucggcaagggguggccccugagcaagauggacaucggcgucccccugcucgcgaucgggugcuacucccaggugaacccgaucacccugacggccgcccugcuccugcugguggcccacuacgccaucaucggccccggccuccaggcgaaggccacccgcgaggcccagaagcgggccgccgcggggaucaugaagaaccccaccgucgacggcaucaccgugaucgaccuggagcccaucccguacgaccccaaguucgagaagcagcugggccaggugaugcuccugauccugugcgucacccaggugcucaugaugcgcaccaccugggcccugugcgaggcccugacccucgccacgggccccaucagcacccugugggaggggaaccccggccgguucuggaacaccaccaucgccguguccauggcgaacaucuuccgcggcagcuaccuggccggggccggccuccuguucuccaucaugaagaacacgaccaacacccggcgcgggaccggcaacaucggcgagacgcugggggagaaguggaagucccggcucaacgcccugggcaaguccgaguuccagaucuacaagaaguccgggauccaggaggucgaccgcacccuggcgaaggagggcaucaagcgcggggagaccgaccaccacgccgugucccgcggcagcgccaagcuccggugguucguggagcgcaacauggucaccccggagggcaaggugguggaccuggggugcggccgcggcgggugguccuacuacugcggcgggcugaagaacguccgcgaggugaaggggcucacgaagggcgggcccgggcacgaggagcccauccccaugagcaccuacggcuggaaccuggugcggcugcagagcggggucgacguguucuucaccccgcccgagaagugcgacacccuccugugcgacaucggcgaguccagccccaaccccacgaucgaggccggccgcacccugcgggugcucaaccuggucgagaacuggcugaacaacaacacccaguucugcaucaaggugcucaacccguacaugcccuccgugaucgagaagauggagacccugcagcgcaaguacgggggcgcccugguccggaacccccugagccgcaacuccacccacgagauguacugggugagcaacgcgacggggaacaucguguccagcgucaacaugaucucccgcaugcucaucaaccgguucaccaugaagcacaagaaggccaccuacgagccggacguggaccugggcagcgggacccgcaacaucggcaucgaguccgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgccuccagcauggugaacggggucgugcgccuccugacgaagcccugggacguggucccgauggugacccagauggccaugaccgacaccacgcccuucggccagcagcggguguucaaggagaaggucgacacccgcacccaggagcccaaggagggcaccaagaagcugaugaagaucacggcggaguggcucuggaaggagcuggggaagaagaagacgccccggaugugcacccgcgaggaguucacccggaaggugcgcuccaacgccgcccugggcgccaucuucacggacgagaacaaguggaaguccgcccgggaggcgguggaggacucccgcuucugggagcucaucgaccgggagcgcaaccugcaccuggaggggaagugcgagaccugcgucuacaacaugaugggcaagcgggagaagaagcucggggaguucggcaaggccaagggcagccgcgccaucugguacauguggcugggggcccgguuccuggaguucgaggcgcucggcuuccugaacgaggaccacugguucagccgcgggaacucccugagcggcguggagggggagggccuccaccggcugggcuacauccugcgcgacgucuccaagaaggagggcggggccauguacgccgacgacaccgccgggugggacacccggaucacgcucgaggaccugaagaacgaggagauggugaccaaccacaugaagggcgagcacaagaagcuggccgaggcgaucuucaagcucaccuaccagaacaaggugguccgcgugcagcgcccgacgccccgggggacggugauggacaucaucagccgccgggaccagcgcggcuccggccaggucgggaccuacggccugaacaccuucaccaacauggaggcccagcugauccggcagauggagggggagggcaucuucaagagcauccagcaccucacggugaccgaggagaucgccgugcagaacuggcuggcccgcgucggccgggagcgccugucccggauggccaucagcggggacgacugcguggugaagccccucgacgaccgcuucgcguccgcccugaccgcccugaacgacaugggcaagguccggaaggacauccagcagugggagcccagccgcggguggaacgacuggacccaggugccguucugcucccaccacuuccacgagaucgugaugaaggacggccggguccucguggugcccugccgcaaccaggacgagcugaucgggcgggcccgcaucagccagggcgccggcuggucccugaaggagacggcgugccucggcaagagcuacgcccagauguggacccugauguacuuccaccggcgcgaccugcggcucgccgccaacgccaucugcuccgcgguccccagccacugggugcccaccucccgcaccaccuggagcauccacgccaagcacgaguggaugacgaccgaggacaugcuggccguguggaaccgcgucuggauccaggagaacccguggauggaggacaagacccccguggagagcugggaggaggugcccuaccugggcaagcgggaggaccaguggugcgggucccucaucggccugaccagccgcgccacgugggcgaagaacauccagaccgccaucaaccagguccggucccugaucgggaacgaggaguacaccgacuacaugcccagcaugaagcgcuuccggcgcgaggaggaggaggccggcgugcucugguga

SEQ ID NO: 9389 - RNA, 9876 nt, Artificial Sequence
  derived and/or modified CDS sequence (opt1) from DENV-2__EU482588__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaaggugcccuucgagaucauggaccucgagaagcggcacgugcuggggcgccugaucaccgucaacccgaucgugaccgagaaggacagccccgugaacaucgaggcggagccgcccuucggcgacuccuacaucaucaucggggucgagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccagguguucggcgcgaucuacggcgccgccuucagcggggucuccuggaccaugaagauccugaucggcgugaucaucacguggaucgggaugaacagccgcuccaccagccuguccgugagccucguccuggugggcguggucacccuguaccucggggccauggugcaggcggacuccggcugcguggucagcuggaaguccaaggagcugaagugcggcagcgggaucuucgugaccgacaacgugcacacguggaccgagcaguacaaguuccagcccgagagccccuccaagcuggccagcgccauccagaaggcccacgaggagggcaucugcgggauccgguccgucacccgccucgagaaccugauguggaagcagaucacccccgagcugaaccacauccucagcgagaacgaggugaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccagaccuuccugaucgacgggcccgagaccgccgagugcccgaacaccaaccgggccuggaacucccucgagguggaggacuacggcuucggggucuucacgaccaacaucuggcugaagcugcgcgagaagcaggacguguucugcgacagcaagcucauguccgccgccaucaaggacaaccgggcggugcacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggcggggcccuggcaccugggcaagcuggagauggacuucgacuucugcgaggggaccaccgucguggugaccgaggacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggucaacucccucgugaccgccgggcacggccagaucgacaacuucagccugggcgugcuggggauggcccucuuccuggaggagaugcugcggacccgcgucggcaccaagcacgcgauccuccugguggccguguccuucgucacgcugaucaccgggaacaugagcuuccgggaccucggccgcgugauggugauggucggggccaccaugaccgacgacaucggcaugggcgugacguaccuggcccugcucgccgcguucaaggugcgccccaccuucgccgccgggcugcugcuccggaagcugaccuccaaggagcugaugauggccaccaucggcaucgcccuccugagccaguccacgauccccgagaccauccuggagcucaccgacgcgcuggcccuggggaugaugguccucaagaucgugcgcaacauggagaaguaccagcuggccgugaccaucauggccaucagcugcgucccgaacgccgugauccugcagaacgcguggaaggucuccugcacgauccucgccgccgugagcgugagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccgucggcaugguguccauccuggccagcagccugcucaagaacgacauccccaugaccgggccccugguggcgggcgggcugcucacggucugcuacgugcugaccggccgguccgccgaccuggagcucgagcgcgccgccgacgugaagugggaggaccaggccgagaucagcggguccagccccauccuguccaucaccaucagcgaggacggcuccaugagcaucaagaacgaggaggaggagcagacccugacgauccucauccggaccggccugcuggucaucuccgggguguucccggugagcauccccaucaccgcggccgccugguaccucugggaggucaagaagcagcgcgccggcgugcugugggacgugcccagcccgccgcccgucgggaaggccgagcuggaggacggcgcguaccggaucaagcagcgcgggauccucggcuacagccagaucggcgccgggguguacaaggagggcaccuuccacaccauguggcacgugacgcgcggggccguccugaugcaccgcggcaagcggaucgagcccuccugggccgacgugaagaaggaccugaucagcuacgggggcggcuggaagcucgagggggaguggaaggagggcgaggaggugcagguccuggcccuggagcccgggaagaacccccgcgcggugcagaccaagcccggccucuucaagaccaacaccgggacgaucggcgccgugucccuggacuucagccccggcaccuccgggagccccaucgucgaccggaagggcaaggugguggggcuguacggcaacggcgucgugacccgcuccggggccuacgugagcgccaucgcgcagaccgagaaguccaucgaggacaaccccgagaucgaggacgacaucuuccggaagaagcgccucacgaucauggaccugcaccccggcgccgggaagaccaagcgguaccugcccgccaucguccgcgaggccaucaagcggggccugcgcacccucauccuggccccgacccgcgugguggcggccgagauggaggaggcccugcgggggcuccccauccgcuaccagacgcccgccauccgggccgagcacaccggccgcgagaucgucgaccugaugugccacgcgaccuucaccaugcggcugcucucccccgugcgcgugccgaacuacaaccugaucaucauggacgaggcccacuucacggaccccgccagcaucgccgcccggggcuacaucuccacccgcgucgagaugggggaggcggccggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgugugguucgucccgagcaucaaggcgggcaacgacaucgccgccugccugcgcaagaacggcaagaaggugauccagcucucccggaagaccuucgacagcgaguacgugaagacccgcgccaacgacugggacuucgucgugacgaccgacaucuccgagaugggggccaacuucaaggcggagcgggugaucgacccccgccggugcaugaagcccgucauccugaccgacggcgaggagcgcgugauccuggccgggcccaugccggugacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacgcccgagggcaucaucccgagcauguucgagcccgagcgcgagaaggucgacgccaucgacggggaguaccggcuccgcggcgaggcccggaagaccuucguggaccugaugcgccgcggggaccugcccguguggcucgccuaccgcgucgccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucacggagauggggcggcuccccaccuucaugacccagaaggcccgcgacgcccuggacaaccuggccgugcuccacaccgcggaggccggcgggcgggccuacaaccacgcccuguccgagcugcccgagacgcucgagacccugcugcuccugacccugcucgccaccgugacgggcggcaucuuccuguuccugaugagcgggaagggcaucgggaagaugacccucggcaugugcugcaucaucaccgcguccauccugcugugguacgcccagauccagccgcacuggaucgccgccagcaucauccucgaguucuuccugaucguccugcucauccccgagcccgagaagcagcgcacgccccaggacaaccagcugaccuacguggugaucgccauccugacggucguggcggccaccauggccaacgagaugggguuccucgagaagaccaagaaggaccugggccugggcagcaucaccacgcaggaguccgagagcaacauccucgacaucgaccugcggccggccuccgccuggacccuguacgcgguggccaccaccuucgucacgcccaugcuccgccacagcaucgagaacuccagcgugaacgugucccugaccgccaucgccaaccaggcgaccguccugauggggcucggcaagggguggccccugagcaagauggacaucggcgugccccugcucgccaucgggugcuacucccaggugaacccgaucacccugacggccgcccugcuccugcuggucgcccacuacgcgaucaucggccccggccuccaggccaaggccacccgggaggcccagaagcgcgccgcggccgggaucaugaagaaccccaccguggacggcaucaccgugaucgaccuggagcccaucccguacgaccccaaguucgagaagcagcuggggcaggucaugcuccugauccugugcgugacccagguccucaugaugcgcaccaccugggcccugugcgaggcccugacccucgccacgggccccaucagcacccugugggaggggaaccccggccgguucuggaacaccaccaucgcggucuccauggccaacaucuuccgcggcagcuaccuggccggggccggccuccuguucuccaucaugaagaacacgaccaacacccggcgcgggaccggcaacaucggcgagacgcugggggagaaguggaagucccggcucaacgcgcugggcaaguccgaguuccagaucuacaagaaguccgggauccaggagguggaccgcacccuggccaaggagggcaucaagcgcggggagaccgaccaccacgccgugucccgcggcagcgccaagcuccggugguucgucgagcgcaacauggugaccccggagggcaagguggucgaccuggggugcggccgcggcgggugguccuacuacugcggcgggcugaagaacgugcgcgaggugaaggggcucacgaagggcgggcccgggcacgaggagcccauccccaugagcaccuacggcuggaaccugguccggcugcagagcgggguggacguguucuucaccccgcccgagaagugcgacacccuccugugcgacaucggcgaguccagccccaaccccacgaucgaggccggccgcacccugcggguccucaaccugguggagaacuggcugaacaacaacacccaguucugcaucaaggugcucaacccguacaugcccuccgucaucgagaagauggagacccugcagcgcaaguacgggggcgcgcuggugcggaacccccugagccgcaacuccacccacgagauguacugggugagcaacgccacggggaacaucgucuccagcgugaacaugaucucccggaugcucaucaaccgcuucaccaugaagcacaagaaggccaccuacgagccggacguggaccugggcagcgggacccgcaacaucggcaucgaguccgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgccuccagcauggucaacgggguggugcgccuccugacgaagcccugggacgucgugccgauggugacccagauggcgaugaccgacaccacgcccuucggccagcagcgggucuucaaggagaagguggacacccgcacccaggagcccaaggagggcaccaagaagcugaugaagaucacggccgaguggcucuggaaggagcuggggaagaagaagacgccccggaugugcacccgcgaggaguucacccggaaggugcgcuccaacgccgcccugggcgccaucuucacggacgagaacaaguggaaguccgcgcgggaggccgucgaggacucccgcuucugggagcucaucgaccgggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgccgacgacaccgccgggugggacacccggaucacgcucgaggaccugaagaacgaggagauggugaccaaccacaugaagggcgagcacaagaagcuggcggaggccaucuucaagcucaccuaccagaacaaggucgugcgcgugcagcggccgacgccccgggggacggucauggacaucaucagccgccgggaccagcgcggcuccggccagguggggaccuacggccugaacaccuucaccaacauggaggcccagcugauccggcagauggagggggagggcaucuucaagagcauccagcaccucacggugaccgaggagaucgccguccagaacuggcuggcccgcgugggccgggagcgccugucccggauggcgaucagcggggacgacugcguggucaagccccucgacgaccgcuucgccuccgcccugaccgcccugaacgacaugggcaaggugcggaaggacauccagcagugggagcccagccgcggguggaacgacuggacccaggugccguucugcucccaccacuuccacgagcucgucaugaaggacggccgggugcuggugguccccugccgcaaccaggacgagcugaucgggcgggcccgcaucagccagggcgcgggcuggucccucaaggagacggccugccugggcaagagcuacgcccagauguggacccugauguacuuccaccggcgcgaccuccggcuggccgccaacgcgaucugcuccgccgugcccagccacugggugcccaccucccgcaccaccuggagcauccacgccaagcacgaguggaugacgaccgaggacaugcuggccgucuggaaccggguguggauccaggagaacccguggauggaggacaagacccccguggagagcugggaggagguccccuaccucggcaagcgcgaggaccaguggugcgggucccugaucggccugaccagccgcgcgacgugggccaagaacauccagaccgccaucaaccaggugcggucccucaucgggaacgaggaguacaccgacuacaugcccagcaugaagcgcuuccggcgcgaggaggaggaggccggcgugcugugguga

SEQ ID NO: 9390 - RNA, 9876 nt, Artificial Sequence
  derived and/or modified CDS sequence (opt1) from DENV-2__EU569705__SS-prME
accgccggcgucaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggccgucuccuucgugacccugaucacggggaacaugagcuuccgggaccucggccgcgugauggucauggugggggccaccaugaccgacgacaucggcaugggcaucaccuaccuggcccugcucgcggccuucaaggugcgccccacguucgccgccgggcugcugcuccggaagcugaccuccaaggagcugaugauggccaccaucggcaucgcgcuccugagccaguccaccauccccgagacgauccuggagcucaccgacgcccuggcccuggggaugaugguccucaagaucgugcgcaacauggagaaguaccagcuggccgugaccaucauggccaucagcugcgucccgaacgcggugauccugcagaacgccuggaagguguccugcaccauccucgccgccgucagcgugagcccccugcugcucacgagcucccagcagaaggcggacuggaucccccuggcccugaccaucaagggccucaaccccaccgccaucuuccugaccacgcugagccggaccuccaagaagcgcagcuggccgcucaacgaggccaucauggccgucggcaugguguccauccuggcgagcagccugcucaagaacgacauccccaugaccgggccccugguggccggcgggcugcucaccgucugcuacgugcugacgggccgguccgccgaccuggagcucgagcgcgccgccgacgugaagugggaggaccaggcggagaucagcggguccagccccauccuguccaucaccaucagcgaggacggcuccaugagcaucaagaacgaggaggaggagcagacccugaccauccucauccggacgggccugcuggucaucuccgggguguucccggugagcauccccaucaccgccgccgccugguaccucugggaggucaagaagcagcgcgccggcgugcugugggacgugcccagcccgccgcccgucgggaaggcggagcuggaggacggcgccuaccggaucaagcagcgcgggauccucggcuacagccagaucggcgccgggguguacaaggagggcaccuuccacaccauguggcacgugacccgcggggcgguccugaugcaccgcggcaagcggaucgagcccuccugggccgacgugaagaaggaccugaucagcuacgggggcggcuggaagcucgagggggaguggaaggagggcgaggaggugcagguccuggcgcuggagcccgggaagaacccccgcgccgugcagacgaagcccggccucuucaagaccaacaccgggaccaucggcgccgugucccuggacuucagccccggcacguccgggagccccaucgucgaccggaagggcaaggugguggggcuguacggcaacggcgucgugacccgcuccggggccuacgugagcgcgaucgcccagaccgagaaguccaucgaggacaaccccgagaucgaggacgacaucuuccggaagaagcgccucaccaucauggaccugcaccccggcgccgggaagacgaagcgguaccugcccgccaucguccgcgaggccaucaagcggggccugcgcacccucauccuggcgccgacccgcgugguggccgccgagauggaggaggcccugcgggggcuccccauccgcuaccagacccccgccauccgggcggagcacacgggccgcgagaucgucgaccugaugugccacgccaccuucaccaugcggcugcucucccccgugcgcgugccgaacuacaaccugaucaucauggacgaggcccacuucaccgaccccgccagcaucgccgcgcggggcuacaucuccacgcgcgucgagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagacggugugguucgucccgagcaucaaggccggcaacgacaucgccgccugccugcgcaagaacggcaagaaggugauccagcucucccggaagaccuucgacagcgaguacgugaagacccgcgccaacgacugggacuucgucgugaccacggacaucuccgagaugggggcgaacuucaaggccgagcgggugaucgacccccgccggugcaugaagcccgucauccugaccgacggcgaggagcgcgugauccuggccgggcccaugccggugacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaaggucgacgccaucgacggggaguaccggcuccgcggcgaggcccggaagacguucguggaccugaugcgccgcggggaccugcccguguggcucgccuaccgcgucgcggccgagggcaucaacuacgccgaccggcgcuggugcuucgacgggaucaagaacaaccagauccuggaggagaacguggagguggagaucuggaccaaggagggcgagcggaagaagcugaagccgcgcuggcucgacgcccggaucuacuccgacccccuggcgcugaaggaguucaaggaguucgccgccggccgcaagagccucacccugaaccugaucaccgagauggggcggcuccccacguucaugacccagaaggcccgcgacgcccuggacaaccuggcgguccuccacaccgccgaggccggcgggcgggccuacaaccacgcccuguccgagcugcccgagacccucgagacgcugcugcuccugacccugcucgcgaccgugaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccacgauggccaacgagaugggguuccucgagaagaccaagaaggaccugggccugggcagcaucgccacccaggaguccgagagcaacauccucgacaucgaccugcggccggcguccgccuggacccuguacgccguggccacgaccuucgucacccccaugcuccgccacagcaucgagaacuccagcgugaacgugucccugaccgcgaucgccaaccaggccacgguccugauggggcucggcaagggguggccccugagcaagauggacaucggcgugccccugcucgccaucgggugcuacucccaggugaacccgaucacccugaccgccgcgcugcuccugcuggucgcccacuacgccaucaucggccccggccuccaggccaaggccacccgggaggcgcagaagcgcgccgccgccgggaucaugaagaaccccacgguggacggcaucaccgugaucgaccuggagcccaucccguacgaccccaaguucgagaagcagcuggggcaggucaugcuccugauccugugcgugacccaggugcucaugaugcgcaccacgugggcccugugcgaggcgcugacccucgccaccggccccaucagcacccugugggaggggaaccccggccgguucuggaacacgaccaucgccgucuccauggccaacaucuuccgcggcagcuaccuggcgggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggccaaggagggcaucaagcgcggggagacggaccaccacgccgugucccgcggcagcgcgaagcuccggugguucgucgagcgcaacauggugaccccggagggcaagguggucgaccuggggugcggccgcggcgggugguccuacuacugcggcgggcugaagaacgugcgcgaggugaaggggcucaccaagggcggccccgggcacgaggagcccauccccaugagcaccuacggcuggaaccugguccggcugcagagcgggguggacguguucuucacgccgcccgagaagugcgacacccuccugugcgacaucggcgaguccagccccaaccccaccaucgaggccggccgcacccugcggguccucaaccugguggagaacuggcugaacaacaacacgcaguucugcaucaaggugcucaacccguacaugcccuccgucaucgagaagauggagacccugcagcgcaaguacgggggcgcccuggugcggaacccccugagccgcaacuccacccacgagauguacugggugagcaacgccaccgggaacaucgucuccagcgugaacaugaucucccggaugcucaucaaccgcuucaccaugaagcacaagaaggccacguacgagccggacguggaccugggcagcgggacccgcaacaucgucaucgaguccgagauccccaaccuggacaucaucggcaagcggaucgagaagaucaagcaggagcacgagaccagcuggcacuacgaccaggaccaccccuacaagaccugggcguaccacggcuccuacgagacgaagcagaccgggagcgccuccagcauggugaacggcgugguccgccuccugaccaagcccugggacguggugccgauggucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaagguccgcuccaacgccgcgcugggggccaucuucaccgacgagaacaaguggaaguccgcccgggaggccguggaggacucccgcuucugggagcucaucgaccgggagcgcaaccugcaccuggagggcaagugcgagaccugcguguacaacaugauggggaagcgggagaagaagcucggcgaguucgggaaggcgaagggcagccgcgccaucugguacauguggcugggcgcccgguuccuggaguucgaggcccucggguuccugaacgaggaccacugguucagccgcggcaacucccugagcggggucgagggcgaggggcuccaccggcugggcuacauccugcgcgacguguccaagaaggagggcggggccauguacgcggacgacacggccggcugggacacccggaucacccucgaggaccugaagaacgaggagauggucaccaaccacaugaagggggagcacaagaagcuggccgaggccaucuucaagcucacguaccagaacaagguggugcgcguccagcggccgacgccccggggcaccgugauggacaucaucagccgccgggaccagcgcggguccggccaggugggcaccuacgggcugaacacguucaccaacauggaggcccagcugauccggcagauggagggcgaggggaucuucaagagcauccagcaccucaccgucaccgaggagaucgcggugcagaacuggcuggcccgcgugggccgggagcgccugucccggauggccaucagcggcgacgacugcgucgugaagccccucgacgaccgcuucgccuccgcccugacggcgcugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcccgcaucagccagggggccggcuggucccucaaggagaccgccugccugggcaagagcuacgcccagauguggacccugauguacuuccaccggcgcgaccuccggcuggcggccaacgccaucugcuccgccgugcccagccacuggguccccacgucccgcaccaccuggagcauccacgcgaagcacgaguggaugaccaccgaggacaugcuggccguguggaaccggguguggauccaggagaacccguggauggaggacaagacgcccgucgagagcugggaggaggugcccuaccucgggaagcgcgaggaccaguggugcggcucccugaucgggcugaccagccgcgccaccugggccaagaacauccagaccgccaucaaccaggugcggucccucaucggcaacgaggaguacacggacuacaugcccagcaugaagcgcuuccggcgcgaggaggaggaggcggggguccugugguga

SEQ ID NO: 9391 - RNA, 9876 nt, Artificial Sequence
  derived and/or modified CDS sequence (opt1) from DENV-2__EU482589__SS-prME
accgccggcgugaucaucaugcugauccccaccgccauggcguuccaccucaccacccggaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaugggccuggacuucaacgagaugguccugcuccagauggaggacaaggccuggcuggugcaccggcagugguuccuggaccucccccugcccuggcugccgggggccgacacccagggcagcaacuggauccagaaggagacccucgugacguucaagaacccccacgcgaagaagcaggacgucgugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgccgagacccagcacgggaccaucgugauccgcguccaguacgagggcgacggcucccccugcaagauccccuucgagaucauggaccucgagaagcggcacgugcuggggcgccugaucacggugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcccugcaccagguguucggcgcgaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggccaugguccaggcggacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggccggcaagcggucccugcgcccgcagcccaccgagcucaaguacagcuggaagaccuggggcaaggcgaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaaccuggccgggcccgugagccagcacaacuaccgcccgggcuaccacacccagaccgcggggcccuggcaccugggcaagcucgagauggacuucgacuucugcgaggggacgaccgugguggucaccgaggacugcggcaaccggggccccagccugcgcaccacgaccgccuccgggaagcuggugaccgaguggugcugccggagcugcacccucccgccccugcgcuaccggggcgaggacgggugcugguacggcauggagauccgcccccugaaggagaaggaggagaaccucgugaacucccuggucacggccgggcacggccagaucgacaacuucagccugggcgugcucgggauggcccuguuccuggaggagaugcuccggacccgcgugggcaccaagcacgcgauccugcuggucgccguguccuucgugacccucaucacggggaacaugagcuuccgggaccugggccgcgucauggugauggugggggccaccaugaccgacgacaucggcaugggcgucaccuaccuggcccuccuggccgcguucaaggugcgccccacguucgccgccgggcugcuccugcggaagcugaccuccaaggagcucaugauggccaccaucggcaucgcccugcugagccaguccaccauccccgagacgauccucgagcugaccgacgcgcuggcccucgggaugauggugcugaagaucguccgcaacauggagaaguaccagcuggccgugaccaucauggccaucagcugcgugcccaacgccgucauccuccagaacgcguggaagguguccugcaccauccuggccgccgucagcgugagcccccugcuccugacgagcucccagcagaaggccgacuggaucccccuggcgcucaccaucaagggccugaaccccaccgccaucuuccugaccacgcucagccggaccuccaagaagcgcagcuggccgcugaacgaggccaucauggccgugggcauggucuccauccuggccagcagccuccugaagaacgacauccccaugaccgggccccugguggcgggcgggcuccugaccgugugcuacguccugacgggccgguccgccgaccucgagcuggagcgcgccgccgacgugaagugggaggaccaggccgagaucagcggguccagccccauccuguccaucaccaucagcgaggacggcuccaugagcaucaagaacgaggaggaggagcagacccucaccauccugauccggacgggccugcucgugaucuccggggucuucccggugagcauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacagccagaucggcgccggggucuacaaggagggcaccuuccacaccauguggcacgugacccgcggggccgugcugaugcaccgcggcaagcggaucgagcccuccugggccgacgucaagaaggaccucaucagcuacgggggcggcuggaagcuggagggggaguggaaggagggcgaggagguccaggugcuggcccucgagcccgggaagaacccccgcgcgguccagacgaagcccggccuguucaagaccaacaccgggaccaucggcgccgugucccuggacuucagccccggcacguccgggagccccaucguggaccggaagggcaaggucguggggcucuacggcaacggcguggucacccgcuccggggccuacgugagcgccaucgcgcagaccgagaaguccaucgaggacaaccccgagaucgaggacgacaucuuccggaagaagcgccugaccaucauggaccugcaccccggcgccgggaagacgaagcgguaccugcccgccaucgugcgcgaggccaucaagcggggccuccgcacccugauccuggccccgacccgcgucguggcggccgagauggaggaggcccuccgggggcugcccauccgcuaccagacccccgccauccgggccgagcacacgggccgcgagaucguggaccugaugugccacgcgaccuucaccaugcggcuccugucccccguccgcgugccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggcgggcaacgacaucgccgccugccuccgcaagaacggcaagaaggucauccagcugucccggaagaccuucgacagcgaguacgugaagacccgcgccaacgacugggacuucguggucaccacggacaucuccgagaugggggccaacuucaaggcggagcgggugaucgacccccgccggugcaugaagcccgugauccugaccgacggcgaggagcgcgucauccucgccgggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccgagcauguucgagcccgagcgcgagaagguggacgccaucgacggggaguaccggcugcgcggcgaggcccggaagacguucgucgaccugaugcgccgcggggaccuccccguguggcuggccuaccgcguggccgcggagggcaucaacuacgccgaccggcgcuggugcuucgacgggaucaagaacaaccagauccuggaggagaacgucgagguggagaucuggaccaaggagggcgagcggaagaagcucaagccgcgcuggcuggacgcccggaucuacuccgacccccuggcccucaaggaguucaaggaguucgcggccggccgcaagagccugacccugaaccucaucaccgagauggggcggcugcccacguucaugacccagaaggcccgcaacgcccuggacaaccucgccguccugcacaccgcggaggccggcgggcgggccuacaaccacgcccuguccgagcuccccgagacccuggagacgcugcuccugcugacccuccuggccaccgugaccggcggcaucuuccuguuccucaugagcgggaagggcaucgggaagaugacgcugggcaugugcugcaucaucaccgcguccauccugcucugguacgcccagauccagccgcacuggaucgccgccagcaucauccuggaguucuuccugaucgugcuccugauccccgagcccgagaagcagcgcacgccccaggacaaccagcugaccuacgucgugaucgccauccucaccguggucgcggccacgauggccaacgagaugggguuccuggagaagaccaagaaggaccugggccucggcagcaucaccacccaggaguccgagagcaacauccuggacaucgaccugcggccggccuccgccuggacgcucuacgcgguggccaccaccuucgugacccccaugcugcgccacagcaucgagaacuccagcgucaacgugucccugacggccaucgccaaccaggcgaccgugcucauggggcugggcaagggguggccccugagcaagauggacaucggcgucccccuccuggccaucgggugcuacucccaggugaacccgaucacccugaccgccgcccuccugcugcucguggcccacuacgcgaucaucggccccggccugcaggccaaggccacgcgggaggcccagaagcgcgccgcggccgggaucaugaagaaccccaccgucgacggcaucaccgugaucgaccuggagcccaucccguacgaccccaaguucgagaagcagcucggccaggugaugcugcugauccucugcgucacccaggugcugaugaugcgcacgaccugggcccugugcgaggcccucacccuggccaccggccccaucagcacgcugugggaggggaaccccggccgguucuggaacaccaccaucgcgguguccauggccaacaucuuccgcggcagcuaccucgccggggccggccugcuguucuccaucaugaagaacaccacgaacacccggcgcgggaccggcaacaucggcgagacccucggggagaaguggaagucccggcugaacgcgcugggcaagagcgaguuccagaucuacaagaaguccgggauccaggaggucgaccgcacgcucgccaaggagggcaucaagcgcggggagaccgaccaccacgccgugucccgcggcagcgccaagcugcggugguucguggagcgcaacauggucaccccggagggcaaggugguggaccuggggugcggccgcggcgggugguccuacuacugcggcgggcucaagaacguccgcgaggugaaggggcugaccaagggcgggcccgggcacgaggagcccauccccaugagcacguacggcuggaaccuggugcggcuccagagcggggucgacguguucuucaccccgcccgagaagugcgacacccugcugugcgacaucggcgaguccagccccaaccccaccaucgaggccggccgcacgcuccgggugcugaaccuggucgagaacuggcucaacaacaacacccaguucugcaucaaggugcugaacccguacaugcccuccgugaucgagaagauggagacccugcagcgcaaguacgggggcgcgcugguccggaacccccucagccgcaacuccacccacgagauguacugggugagcaacgccaccgggaacaucguguccagcgucaacaugaucucccggaugcugaucaaccgcuucacgaugaagcacaagaaggccaccuacgagccggacguggaccugggcagcgggacccgcaacaucggcaucgaguccgagauccccaaccucgacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacggggucgugcgccugcugaccaagcccugggacguggucccgauggugacgcagauggcgaugaccgacaccacccccuucggccagcagcggguguucaaggagaaggucgacacgcgcacccaggagcccaaggagggcaccaagaagcucaugaagaucaccgccgaguggcuguggaaggagcuggggaaggagaagacgccccggaugugcacccgcgaggaguucacccggaaggugcgcuccaacgccgcccucggcgccaucuucaccgacgagaacaaguggaaguccgcgcgggaggccguggaggacucccgcuucugggagcugaucgaccgggagcgcaaccugcaccucgaggggaagugcgagacgugcgucuacaacaugaugggcaagcgggagaagaagcugggggaguucggcaaggccaagggcagccgcgccaucugguacauguggcugggggcgcgguuccucgaguucgaggcccugggcuuccugaacgaggaccacugguucagccgcgagaacucccucagcgggguggagggcgaggggcugcaccggcugggcuacauccuccgcgacgucuccaagaaggagggcggggccauguacgccgacgacaccgccggcugggacacccggaucacccuggaggaccugaagaacgaggagauggugacgaaccacaugaagggggagcacaagaagcucgcggaggccaucuucaagcugaccuaccagaacaaggugguccgcgugcagcggccgacgccccgcggcaccgugauggacaucaucagccgccgggaccagcgcggguccggccaggucggcaccuacgggcugaacaccuucaccaacauggaggcccagcucauccggcagauggagggcgaggggaucuucaagagcauccagcaccugaccgccacggaggagaucgccgugcagaacuggcuggcgcgcgugggccgggagcgccucucccggauggccaucagcggcgacgacugcgucgugaagccccuggacgaccgcuucgccuccgcccugaccgcccucaacgacauggggaaggugcggaaggacauccagcagugggagcccagccgcggcuggaacgacuggacccaggucccguucugcucccaccacuuccacgagcuggugaugaaggacgggcgggugcuggucgugcccugccgcaaccaggacgagcucaucggccgggcgcgcaucagccagggggccggcuggucccugaaggagaccgccugccugggcaagagcuacgcccagauguggacgcucauguacuuccaccggcgcgaccugcggcuggccgcgaacgccaucugcuccgccgugcccagccacuggguccccaccucccgcaccaccuggagcauccacgccaagcacgaguggaugaccacggaggacaugcucgcgguguggaaccggguguggauccaggagaacccguggauggaggacaagacccccgucgagagcugggaggaggugcccuaccuggggaagcgcgaggaccaguggugcggcucccugaucgggcucaccagccgcgccaccugggccaagaacauccagacggccaucaaccaggugcggucccugaucggcaacgaggaguacaccgacuacaugcccagcaugaagcgcuuccggcgcgaggaggaggaggccgggguccugugguga

SEQ ID NO: 9392 - RNA, 9876 nt, Artificial Sequence
  derived and/or modified CDS sequence (opt1) from DENV-2__EU569706__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucguggcggagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggugaugguccaggcggacuccggcugcguggugagcuggaagaacaaggagcugaagugcggcuccgggaucuucaucaccgacaacguccacaccuggacggagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugaccaucaugacgggcgacaucaaggggaucaugcaggccggcaagcggagccugcgcccgcagcccaccgagcucaaguacuccuggaagaccuggggcaaggcgaagaugcugagcaccgagucccacaaccagacguuccugaucgacgggcccgagaccgccgagugcccgaacaccaaccgggccuggaacagccucgaggucgaggacuacggcuucgggguguucuccaccaacaucuggcugaagcugcgcgagaagcaggacguguucugcgacagcaagcucauguccgccgccaucaaggacaaccgggcgguccacgccgacaugggcuacuggaucgagagcgcccugaacgacacguggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgcggggcccuggcaccugggcaagcuggagauggacuucgacuucugcgaggggaccacggugguggucaccgaggacugcggcaaccggggccccagccuccgcaccaccacggccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacgcgcgugggcaccaagcacgcgauccuccugguggccgucuccuucgugacccugaucaccgggaacaugagcuuccgggaccucggccgcgugauggucauggugggggccacgaugaccgacgacaucggcaugggcgugaccuaccuggcccugcucgccgcguucaagguccgccccaccuucgccgccgggcugcugcuccggaagcugacguccaaggagcugaugauggccaccaucggcaucgcccuccugagccaguccaccauccccgagaccauccuggagcucacggacgcgcuggcccuggggaugauggugcucaagaucgugcgcaaccuggagaaguaccagcuggccgucaccaucauggccaucagcugcgugccgaacgccgugauccuccagaacgcguggaaggucuccugcaccauccuggccgccgugagcgucagcccccugcuccugaccagcucccagcagaaggccgacuggaucccccuggcgcucacgaucaagggccugaaccccaccgccaucuuccugaccacccucagccggacguccaagaagcgcagcuggccgcugaacgaggccgugauggccgugggcauggucuccauccuggccagcagccuccugaagaacgacauccccaugaccgggccccugguggcgggcgggcuccugaccgugugcuacguccugaccggccgguccgccgaccucgagcuggagcgcgccgccgacgugaagugggaggaccaggccgagaucagcggguccagccccauccuguccaucacgaucagcgaggacggcuccaugagcaucaagaacgaggaggaggagcagacccucaccauccugauccggaccggccugcucgugaucuccggggucuucccggugagcauccccaucacggcggccgccugguaccugugggaggugaagaagcagcgcgccggcguccugugggacgugcccagcccgccgcccguggggaaggccgagcucgaggacggcgcguaccggaucaagcagcgcgggaucuucggcuacagccagaucggcgccggggucuacaaggagggcaccuuccacaccauguggcacgugacccgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgcgguccagaccaagcccggccucuucaagacgaacaccgggaccaucggcgccgugucccuggacuucagccccggcaccuccgggagccccaucguggaccggaagggcaaggucguggggcuguacggcaacggcguggucacgcgcuccggggccuacgugagcgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucucccccguccgcgugccgaacuacaaccugaucaucauggacgaggcccacuucaccgaccccgccagcaucgccgcccggggcuacaucuccacccgcguggagaugggggaggcggccggcaucuucaugacggccacgccgcccgggagccgggacccguucccccaguccaacgcccccaucauggacgaggagcgcgagauccccgagcggagcuggaacuccggccacgagugggucaccgacuucaaggggaagaccgugugguucgugccgagcaucaaggcgggcaacgacaucgccgccugccugcgcaagaacggcaagaaggucauccagcucucccggaagacguucgacagcgaguacgugaagacccgcgccaacgacugggacuucguggucaccaccgacaucuccgagaugggggccaacuuccgggcggagcgcgugaucgacccccggcgcugcaugaagcccgugauccugacggacggcgaggagcgggucauccuggccgggcccaugccggugacccacagcuccgccgcccagcgccgcggccggaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacgggaucaagaacaaccagauccuggaggagaacgucgagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccguccuccacaccgcggaggugggcgggcgcgccuacaaccacgcccuguccgagcugcccgagacccucgagacccugcugcuccugacgcugcucgccaccgugaccggcggcaucuuccuguuccugaugagcgggaagggcaucgggaagaugacccucggcaugugcugcaucaucacggccuccauccugcugugguacgcgcagauccagccgcacuggaucgccgccagcaucauccucgaguucuuccugaucguccugcucauccccgagcccgagaagcagcggacgccccaggacaaccagcugaccuacguggugaucgccauccugaccgucguggccgcgaccauggccaacgagaugggguuccucgagaagacgaagaaggaccugggccugggcagcaucaccacccaggaguccgagagcaacauccucgacaucgaccugcgcccggccuccgccuggacccuguacgccguggcgacgaccuucgucacccccaugcuccggcacagcaucgagaacuccagcgugaacgugucccugaccgccaucgccaaccaggccacgguccugauggggcucggccgcggguggccccugagcaagauggacaucggcgugccccugcucgcgaucgggugcuacucccaggugaacccgaucacccugaccgccgcccugcuccugcuggucgcccacuacgccaucaucggccccggccuccaggcgaaggccacccgcgaggcccagaagcgggccgccgcggggaucaugaagaaccccacgguggacggcaucaccgugaucgaccuggagcccaucccguacgaccccaaguucgagaagcagcuggggcaggucaugcuccuggugcugugcgugacccagguccucaugaugcgcaccacgugggcccugugcgaggcccugacccucgccaccggccccaucagcacccugugggaggggaaccccggccgguucuggaacacgaccaucgccguguccauggcgaacaucuuccgcggcagcuaccuggccggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggcgaaggagggcaucaagcgcggggagacggaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcaccuacggcuggaaccuggugcggcugcagagcgggguggacgucuucuucacgccgcccgagaagugcgacacccuccugugcgacaucggcgaguccagccccaaccccaccaucgaggccggccgcacccugcgggugcucaaccugguggagaacuggcugaacaacaacacgcaguucugcaucaagguccucaacccguacaugcccuccgugaucgagaagauggagacccugcagcgcaaguacgggggcgcccuggugcggaacccccugagccgcaacuccacccacgagauguacugggucagcaacgcgaccgggaacaucguguccagcgugaacaugaucucccgcaugcucaucaaccgguucaccaugaagcacaagaaggccacguacgagccggacgucgaccugggcagcgggacccgcaacaucggcaucgagaacgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggugaacggggugguccgccuccugaccaagcccugggacguggugccgauggucacccagauggccaugacggacaccacccccuucggccagcagcggguguucaaggagaagguggacacccgcacgcaggagcccaaggagggcaccaagaagcugaugcggaucaccgcggaguggcucuggaaggagcuggggaagaagaagacgccccggaugugcacgcgggaggaguucacccgcaagguccggagcaacgccgcccugggcgccaucuucaccgacgagaacaaguggaaguccgcccgcgaggcgguggaggacagccgguucugggagcucgucgaccgcgagcggaaccugcaccuggaggggaagugcgagaccugcguguacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggggaacagccuguccggcguggagggggagggccuccacaagcugggcuacauccugcgcgacgucagcaagaaggagggcggcgccauguacgccgacgacacggccgggugggacacccggaucacccucgaggaccugaagaacgaggagauggugaccaaccacaugaagggcgagcacaagaagcuggccgaggcgaucuucaagcucacguaccagaacaaggugguccgcgugcagcgcccgacgccccgggggaccgugauggacaucaucucccgcaaggaccagcggggcagcggccaggucgggaccuacggccugaacacguucaccaacauggaggcccagcugauccgccagauggagggggagggcaucuucaaguccauccagcaccucaccgugaccgaggagaucgccgugcagaacuggcuggcccgggucggccgcgagcggcugagccgcauggccaucuccggggacgacugcguggugaagccccucgacgaccgguucgcgagcgcccugacggcccugaacgacaugggcaagguccgcaaggacauccagcagugggagcccucccggggguggaacgacuggacccaggugccguucugcagccaccacuuccacgagcucgugaugaaggacggccgcguccugguggugcccugccggaaccaggacgagcugaucgggcgcgcccggaucucccagggcgccggcuggagccucaaggagaccgcgugccuggggaaguccuacgcccagauguggacccugauguacuuccaccgccgggaccuccgccuggccgccaacgccaucugcagcgcgguccccucccacugggugcccacgagccggaccaccugguccauccacgccaagcacgaguggaugaccaccgaggacaugcuggccguguggaaccgcgucuggauccaggagaacccguggauggaggacaagacgcccguggagagcugggaggaggugcccuaccucggcaagcgcgaggaccaguggugcgggagccugaucggccugaccucccgggccaccugggcgaagaacauccagaccgccaucaaccagguccgcagccucaucgggaacgaggaguacacggacuacaugcccuccaugaagcgguuccgcaaggaggaggaggaggccggcgugcugugguga

SEQ ID NO: 9393 - RNA, 9876 nt, Artificial Sequence
  derived and/or modified CDS sequence (opt1) from DENV-2__EU569707__SS-prME
accgcgggggugaucaucaugcugauccccaccgccauggcguuccaccucaccacccgcaacggggagccccacaugaucgucgggcggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcguggaggccaagcugacgaacaccaccaccgagucccggugcccgacgcagggcgagcccagccugaacgaggagcaggacaagcgcuucgugugcaagcacuccauggucgaccggggcugggggaacggcugcggccucuucggcaagggcgggaucgugaccugcgcgauguucacgugcaagaagaacauggagggcaaggugguccugcccgagaaccuggaguacaccaucgugaucacgccccacagcggggaggagcacgccgugggcaacgacaccgggaagcacggcaaggagaucaagaucaccccgcaguccagcaucaccgaggccgagcucaccggguacggcacggucaccauggagugcagcccccgcaccggccuggacuucaacgagauggugcugcuccggauggaggacaaggccuggcuggugcaccgccagugguuccuggaccucccccugcccuggcugccgggggccgacacccagggcagcaacuggauccagaaggagacgcucgucaccuucaagaacccccacgcgaagaagcaggacguggucgugcuggggucccaggagggcgccaugcacaccgcccugaccggggccacggagauccagaugagcagcggcaaccuccuguucaccggccaccugaagugccggcuccgcauggacaagcugcagcugaaggggauguccuacagcaugugcaccggcaaguucaagaucgugaaggagaucgccgagacccagcacgggacgaucgucauccgggugcaguacgagggcgacggcucccccugcaagauccccuucgagaucauggaccucgagaagcgccacgugcuggggcgccugaucaccgucaacccgaucguggcggagaaggacagccccgugaacaucgaggccgagccgcccuucggcgacuccuacaucaucaucggggucgagccgggccagcucaagcugaacugguucaagaaggggagcuccaucggccagauguucgagaccaccaugcggggcgccaagcgcauggccauccugggggacacggccugggacuucggcagccucgggggcguguucaccuccaucgggaaggcgcugcaccagguguucggcgccaucuacggcgccgccuucagcggggucuccuggaccaugaagauccugaucggcgugaucaucaccuggaucgggaugaacagccgguccacgagccuguccgugagccucguccuggugggcguggucacccuguaccucggggcgauggugcaggccgacuccggcugcguggucagcuggaaguccaaggagcugaagugcggcagcgggaucuucaucaccgacaacgugcacaccuggacggagcaguacaaguuccagcccgagagccccuccaagcuggccagcgccauccagaaggcccacgaggagggcaucugcgggauccgcuccgugacccggcucgagaaccugauguggaagcagaucacccccgagcugaaccacauccucagcgagaacgaggucaagcugaccaucaugacgggcgacaucaaggggaucaugcaggcgggcaagcgcucccugcggccgcagcccaccgagcucaaguacagcuggaagaccuggggcaaggccaagaugcuguccaccgagagccacaaccagacguuccugaucgacgggcccgagaccgccgagugcccgaacaccaaccgcgccuggaacucccucgagguggaggacuacggcuucgggguguucaccacgaacaucuggcugaagcugcgggagaagcaggacgucuucugcgacagcaagcucauguccgccgcgaucaaggacaaccgcgccgugcacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccggccgggcuaccacacccagaccgccgggcccuggcaccugggcaagcuggagauggacuucgacuucugcgaggggacgaccguggucgugaccgaggacugcggcaaccgcggccccagccuccggaccacgaccgccuccgggaagcugaucaccgaguggugcugccgcagcugcacccugcccccgcuccgguaccgcggcgaggacgggugcugguacggcauggagauccggccccugaaggagaaggaggagaaccuggugaacucccucgucacggccgggcacggccagaucgacaacuucagccugggcgugcuggggauggcccucuuccuggaggagaugcugcgcacccgggugggcaccaagcacgccaugcuccuggucgccguguccuucgugacccugaucacggggaacaugagcuuccgcgaccucggccgcgucauggugauggugggggccaccaugaccgacgacaucggcaugggcaucaccuaccuggcccugcucgcggccuucaagguccggcccacguucgccgccgggcugcugcuccgcaagcugaccuccaaggagcugaugauggccaccaucggcaucgcgcuccugagccaguccaccauccccgagacgauccuggagcucaccgacgcccuggcccuggggaugauggugcucaagaucgugcggaacauggagaaguaccagcuggccgucaccaucauggccaucagcugcgugccgaacgcggugauccugcagaacgccuggaaggucuccugcaccauccucgccgccgugagcgucagcccccugcugcucacgagcucccagcagaaggcggacuggaucccccuggcccugaccaucaagggccucaaccccaccgccaucuuccugaccacgcugagccgcaccuccaagaagcggagcuggccgcucaacgaggccaucauggccgugggcaugguguccauccuggcgagcagccugcucaagaacgacauccccaugaccgggccccuggucgccggcgggcugcucaccgugugcuacgugcugacgggccgcuccgccgaccuggagcucgagcgggccgccgacgucaagugggaggaccaggcggagaucagcggguccagccccauccuguccaucaccaucagcgaggacggcuccaugagcaucaagaacgaggaggaggagcagacccugaccauccucauccgcacgggccugcuggugaucuccgggguguucccggucagcauccccaucaccgccgccgccugguaccucugggaggugaagaagcagcgggccggcgugcugugggacguccccagcccgccgcccguggggaaggcggagcuggaggacggcgccuaccgcaucaagcagcgggggauccucggcuacagccagaucggcgccgggguguacaaggagggcaccuuccacaccauguggcacgucacccgcggggccgugcugaugcaccggggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagacgaagcccggccucuucaagaccaacaccgggaccaucggcgccgucucccuggacuucagccccggcacguccgggagccccaucguggaccgcaagggcaagguggucgggcuguacggcaacggcguggugacccgguccggggccuacgucagcgcgaucgcccagaccgagaaguccaucgaggacaaccccgagaucgaggacgacaucuuccgcaagaagcggcucaccaucauggaccugcaccccggcgccgggaagacgaagcgcuaccugcccgccaucgugcgggaggccaucaagcgcggccugcgcacccucauccuggcgccgacccggguggucgccgccgagauggaggaggcccugcgcgggcuccccauccgguaccagacccccgccauccgcgcggagcacacgggccgggagaucguggaccugaugugccacgccaccuucaccaugcgccugcucucccccgugcgggucccgaacuacaaccugaucaucauggacgaggcccacuucaccgaccccgccagcaucgccgcgcgcggcuacaucuccacgcggguggagaugggggaggccgccggcaucuucaugaccgccacgccgcccgggagccgcgacccguucccccaguccaacgcgcccaucauggacgaggagcgggagauccccgagcgcagcuggaacuccggccacgagugggugaccgacuucaaggggaagacggucugguucgugccgagcaucaaggccggcaacgacaucgccgccugccugcggaagaacggcaagaaggugauccagcucucccgcaagaccuucgacagcgaguacgucaagacccgggccaacgacugggacuucguggugaccacggacaucuccgagaugggggcgaacuucaaggccgagcgcgucaucgacccccggcgcugcaugaagcccgugauccugaccgacggcgaggagcgggugauccuggccgggcccaugccggucacccacagcuccgccgcccagcgccgcggccggaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaagguggacgccaucgacggggaguaccgccuccggggcgaggcccgcaagacguucguggaccugaugcggcgcggggaccugcccgucuggcucgccuaccggguggcggccgagggcaucaacuacgccgaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcgcugaaggaguucaaggaguucgccgccggccggaagucccucacccugaaccugaucaccgagauggggcgccuccccacguucaugacccagaaggcccgggacgcccuggacaaccuggcggugcuccacaccgccgaggccggcgggcgcgccuacaaccacgcccuguccgagcugcccgagacccucgagacgcugcugcuccugacccugcucgcgaccgucaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugaccuacguggucaucgcgauccugaccgugguggccgccacgauggccaacgagaugggguuccucgagaagaccaagaaggaccugggccugggcagcaucgccacccaggaguccgagagcaacauccucgacaucgaccugcgcccggcguccgccuggacccuguacgccgucgccacgaccuucgugacccccaugcuccggcacagcaucgagaacuccagcgugaacgucucccugaccgcgaucgccaaccaggccacggugcugauggggcucggcaagggguggccccugagcaagauggacaucggcgugccccugcucgccaucgggugcuacucccaggucaacccgaucacccugaccgccgcgcugcuccugcugguggcccacuacgccaucaucggccccggccuccaggccaaggccacccgcgaggcgcagaagcgcgccgccgccgggaucaugaagaaccccacgguggacggcaucaccgucaucgaccuggagcccaucccguacgaccccaaguucgagaagcagcugggccaggugaugcuccugauccugugcgugacccagguccucaugaugcggaccacgugggcccugugcgaggcgcugacccucgccaccggccccaucagcacccugugggaggggaaccccggccgcuucuggaacacgaccaucgccguguccauggccaacaucuuccggggcagcuaccuggcgggggccggccuccuguucuccaucaugaagaacaccaccaacacgcgccgggggaccggcaacaucggcgagacccugggggagaaguggaagucccgccucaacgcccugggcaaguccgaguuccagaucuacaagaaguccgggauccaggagguggaccggacccuggccaaggagggcaucaagcgcggggagacggaccaccacgccgucucccggggcagcgcgaagcuccgcugguucguggagcggaacauggugaccccggagggcaaggucguggaccuggggugcggccgcgggggcugguccuacuacugcgggggccugaagaacgugcgggaggucaagggccucaccaagggcgggcccgggcacgaggagcccauccccaugagcaccuacggcuggaaccuggugcgccugcagagcgggguggacgucuucuucacgccgcccgagaagugcgacacccuccugugcgacaucggcgaguccagccccaaccccaccaucgaggccggccggacccugcgcgugcucaaccugguggagaacuggcugaacaacaacacgcaguucugcaucaagguccucaacccguacaugcccuccgugaucgagaagauggagacccugcagcggaaguacgggggcgcccuggugcgcaacccccugagccggaacuccacccacgagauguacugggucagcaacgccaccgggaacaucguguccagcgugaacaugaucucccgcaugcucaucaaccgcuucaccaugaagcacaagaaggccacguacgagccggacgucgaccugggcagcgggacccggaacaucggcaucgaguccgagauccccaaccuggacaucaucggcaagcgcaucgagaagaucaagcaggagcacgagaccagcuggcacuacgaccaggaccaccccuacaagaccugggcguaccacggguccuacgagacgaagcagaccggcagcgccuccagcauggugaacggggugguccggcuccugaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcucuggaaggagcuggggaagaagaagacgccccgcaugugcacgcgggaggaguucacccgcaagguccgguccaacgccgcgcugggcgccaucuucaccgacgagaacaaguggaaguccgcccgcgaggccguggaggacucccgguucugggagcucaucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucagccgggggaacucccugagcggcgucgagggggagggccuccaccgccugggcuacauccugcgggacguguccaagaaggagggcggggccauguacgcggacgacacggccgggugggacacccgcaucacccucgaggaccugaagaacgaggagauggucaccaaccacaugaagggcgagcacaagaagcuggccgaggccaucuucaagcucacguaccagaacaagguggugcggguccagcgcccgacgccccgcgggaccgugauggacaucaucagccggcgcgaccagcggggcuccggccagguggggaccuacggccugaacacguucaccaacauggaggcccagcugauccgccagauggagggggagggcaucuucaagagcauccagcaccucaccgucaccgaggagaucgcggugcagaacuggcuggcccgggugggccgcgagcggcugucccgcauggccaucagcggggacgacugcgucgugaagccccucgacgaccgguucgccuccgcccugacggcgcugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggaaccaggacgagcugaucgggcgcgcccggaucagccagggcgccggcuggucccucaaggagaccgccugccugggcaagagcuacgcccagauguggacccugauguacuuccaccgccgggaccuccgccuggcggccaacgccaucugcuccgccgugcccagccacuggguccccacgucccggaccaccuggagcauccacgcgaagcacgaguggaugaccaccgaggacaugcuggccguguggaaccgcguguggauccaggagaacccguggauggaggacaagacgcccgucgagagcugggaggaggugcccuaccucggcaagcgcgaggaccaguggugcgggucccugaucggccugaccagccgggccaccugggccaagaacauccagaccgccaucaaccaggugcgcucccucaucgggaacgaggaguacacggacuacaugcccagcaugaagcgguuccgccgggaggaggaggaggcgggcguccugugguga

SEQ ID NO: 9394 - RNA, 9876 nt, Artificial Sequence
  derived and/or modified CDS sequence (opt1) from DENV-2__EU660399__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggccgucuccuucgugacccugaucacggggaacaugagcuuccgggaccucggccgcgugauggucauggugggggccaccaugaccgacgacaucggcaugggcaucaccuaccuggcccugcucgcggccuucaaggugcgccccacguucgccgccgggcugcugcuccggaagcugaccuccaaggagcugaugauggccaccaucggcaucgcgcuccugagccaguccaccauccccgagacgauccuggagcucaccgacgcccuggcccuggggaugaugguccucaagaucgugcgcaacauggagaaguaccagcuggccgugaccaucauggccaucagcugcgucccgaacgcggugauccugcagaacgccuggaagguguccugcaccauccucgccgccgucagcgugagcccccugcugcucacgagcucccagcagaaggcggacuggaucccccuggcccugaccaucaagggccucaaccccaccgccaucuuccugaccacgcugagccggaccuccaagaagcgcagcuggccgcucaacgaggccgucauggccgugggcaugguguccauccuggcgagcagccugcucaagaacgacauccccaugaccgggccccuggucgccggcgggcugcucaccgugugcuacgugcugacgggccgguccgccgaccuggagcucgagcgcgccgccgacgucaagugggaggaccaggcggagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgccgccgccugguaccucugggaggugaagaagcagcgcgccggcgugcugugggacguccccagcccgccgcccguggggaaggcggagcuggaggacggcgccuaccggaucaagcagcgcgggauccucggcuacagccagaucggcgccgggguguacaaggagggcaccuuccacaccauguggcacgucacccgcggggcggugcugaugcaccgcggcaagcggaucgagcccuccugggccgacgugaagaaggaccugaucagcuacgggggcggcuggaagcucgagggggaguggaaggagggcgaggagguccaggugcuggcgcuggagcccgggaagaacccccgcgccgugcagacgaagcccggccucuucaagaccaacaccgggaccaucggcgccgucucccuggacuucagccccggcacguccgggagccccaucguggaccggcagggcaagguggucgggcuguacggcaacggcguggugacccgcuccggggccuacgucagcgcgaucgcccagaccgagaaguccaucgaggacaaccccgagaucgaggacgacaucuuccggaagaagcgccucaccaucauggaccugcaccccggcgccgggaagacgaagaaguaccugcccgccaucgugcgggaggccaucaagcgcggccugcggacccucauccuggcgccgacccgcguggucgccgccgagauggaggaggcccugcgcgggcuccccauccgguaccagacccccgccauccgcgcggagcacacgggccgggagaucguggaccugaugugccacgccaccuucaccaugcgccugcucucccccgugcgggucccgaacuacaaccugaucaucauggacgaggcccacuucaccgaccccgccagcaucgccgcgcgcggcuacaucuccacgcggguggagaugggggaggccgccggcaucuucaugaccgccacgccgcccgggagccgcgacccguucccccaguccaacgcgcccaucauggacgaggagcgggagauccccgagcgcagcuggaacuccggccacgagugggugaccgacuucaaggggaagacggucugguucgugccgagcaucaaggccggcaacgacaucgccgccugccugcggaagaacggcaagaaggugauccagcucucccgcaagaccuucgacagcgaguacgucaagacccgggccaacgacugggacuucguggugaccacggacaucuccgagaugggggcgaacuucaaggccgagcgcgucaucgacccccggcgcugcaugaagcccgugauccugaccgacggcgaggagcgggugauccuggccgggcccaugccggucacccacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaagguggacgccaucgacggggaguaccgccuccggggcgaggcccgcaagacguucguggaccugaugcggcgcggggaccugcccgucuggcucgccuaccggguggcggccgagggcaucaacuacgccgaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcgcugaaggaguucaaggaguucgccgccggccggaagucccucacccugaaccugaucaccgagauggggcgccuccccacguucaugacccagaaggcccgggacgcccuggacaaccuggcggugcuccacaccgccgaggccggcgggcgcgccuacaaccacgcccuguccgagcugcccgagacccucgagacgcugcugcuccugacccugcucgcgaccgucaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugaccuacguggucaucgcgauccugaccgugguggccgccacgauggccaacgagaugggguuccucgagaagaccaagaaggaccugggccugggcagcaucgccacccaggaguccgagagcaacauccucgacaucgaccugcgcccggcguccgccuggacccuguacgccgucgccacgaccuucgugacccccaugcuccggcacagcaucgagaacuccagcgugaacgucucccugaccgcgaucgccaaccaggccacggugcugauggggcucggcaagggguggccccugagcaagauggacaucggcgugccccugcucgccaucgggugcuacucccaggucaacccgaucacccugaccgccgcgcugcuccugcugguggcccacuacgccaucaucggccccggccuccaggccaaggccacccgcgaggcgcagaagcgggccgccgccgggaucaugaagaaccccacgguggacggcaucaccgucaucgaccuggagcccaucccguacgaccccaaguucgagaagcagcuggggcaggucaugcuccugauccugugcgugacccagguccucaugaugcgcaccacgugggcccugugcgaggcgcugacccucgccaccggccccaucagcacccugugggaggggaaccccggccgcuucuggaacacgaccaucgccguguccauggccaacaucuuccggggcagcuaccuggcgggggccggccuccuguucuccaucaugaagaacaccaccaacacgcgccgggggaccggcaacaucggcgagacccugggggagaaguggaagucccgccucaacgcccugggcaaguccgaguuccagaucuacaagaaguccgggauccaggagguggaccggacccuggccaaggagggcaucaagcgcggggagacggaccaccacgccgucucccggggcagcgcgaagcuccgcugguucguggagcggaacauggugaccccggagggcaaggucguggaccuggggugcggccgcgggggcugguccuacuacugcgggggccugaagaacgugcgggaggucaagggccucaccaagggcgggcccgggcacgaggagcccauccccaugagcaccuacggcuggaaccuggugcgccugcagagcgggguggacgucuucuucacgccgcccgagaagugcgacacccuccugugcgacaucggcgaguccagccccaaccccaccaucgaggccggccggacccugcgcgugcucaaccugguggagaacuggcugaacaacaacacgcaguucugcaucaagguccucaacccguacaugcccuccgugaucgagaagauggagacccugcagcggaaguacgggggcgcccuggugcgcaacccccugagccggaacuccacccacgagauguacugggucagcaacgccaccgggaacaucguguccagcgugaacaugaucucccgcaugcucaucaaccgguucaccaugaagcacaagaaggccacguacgagccggacgucgaccugggcagcgggacccgcaacaucggcaucgaguccgagauccccaaccuggacaucaucggcaagcgcaucgagaagaucaagcaggagcacgagaccagcuggcacuacgaccaggaccaccccuacaagaccugggcguaccacggguccuacgagacgaagcagaccggcagcgccuccagcauggugaacggggugguccggcuccugaccaagcccugggacguggugccgauggucacccagauggccaugacggacaccacccccuucggccagcagcgcguguucaaggagaagguggacacccggacgcaggagcccaaggagggcaccaagaagcugaugaagaucaccgccgaguggcucuggaaggagcuggggaagaagaagacgccccgcaugugcacgcgggaggaguucacccgcaagguccgguccaacgccgcgcugggcgccaucuucaccgacgagaacaaguggaaguccgcccgcgaggccguggaggacucccgguucugggagcucaucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucagccgggggaacucccugagcggcgucgagggggagggccuccaccgccugggcuacauccugcgggacguguccaagaaggagggcggggccauguacgcggacgacacggccgggugggacacccgcaucacccucgaggaccugaagaacgaggagauggucaccaaccacaugaagggcgagcacaagaagcuggccgaggccaucuucaagcucacguaccagaacaagguggugcggguccagcgcccgacgccccgggggaccgugauggacaucaucagccgccgcgaccagcggggcuccggccagguggggaccuacggccugaacacguucaccaacauggaggcccagcugauccgccagauggagggggagggcaucuucaagagcauccagcaccucaccgucaccgaggagaucgcggugcagaacuggcuggcccgggugggccgcgagcggcugucccgcauggccaucagcggggacgacugcgucgugaagccccucgacgaccgguucgccuccgcccugacggcgcugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggaaccaggacgagcugaucgggcgcgcccggaucagccagggcgccggcuggucccucaaggagaccgccugccugggcaagagcuacgcccagauguggacccugauguacuuccaccgccgggaccuccgccuggcggccaacgccaucugcuccgccgugcccagccacuggguccccacgucccggaccaccuggagcauccacgcgaagcacgaguggaugaccaccgaggacaugcuggccguguggaaccgcguguggauccaggagaacccguggauggaggacaagacgcccgucgagagcugggaggaggugcccuaccucggcaagcgggaggaccaguggugcgggucccugaucggccugaccagccgcgccaccugggccaagaacauccagaccgccaucaaccaggugcgcucccucaucgggaacgaggaguacacggacuacaugcccagcaugaagcgguuccgccgggaggaggaggaggcgggcguccugugguga

SEQ ID NO: 9395 - RNA, 9876 nt, Artificial Sequence
  derived and/or modified CDS sequence (opt1) from DENV-2__EU569708__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaucacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggccaccaugaccgacgacaucggcaugggcgugaccuaccuggcccugcucgcggccuucaaggugcgccccacguucgccgccgggcugcugcuccggaagcugaccagcaaggagcugaugauggccaccaucggcaucgcgcuccugucccagagcaccauccccgagacgauccuggagcucaccgacgcccuggcccuggggaugaugguccucaagaucgugcgcaacauggagaaguaccagcuggccgugaccaucauggccaucuccugcgucccgaacgcggugauccugcucaacgccuggaaggugagcugcaccauccuggccgccgucuccgugagcccccugcuccugacguccagccagcagaagaccgacuggaucccccuggcgcucaccaucaagggccugaaccccaccgccaucuuccugacgacccucucccggaccagcaagaagcgcuccuggccgcugaacgaggccgucauggccgugggcauggugagcauccuggccuccagccuccugaagaacgacauccccaugaccgggccccuggucgcgggcgggcuccugacggugugcuacgugcugaccggccggagcgccgaccucgagcuggagcgcgccgccgacgucaagugggaggaccaggccgagaucuccgggagcucccccauccugagcgugaccaucuccgaggacggcagcauguccaucaagaacgaggaggaggagcagacccucacgauccugauccggaccggccugcucgugaucagcggggucuucccgguguccauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacucccagaucggcgccggggucuacaaggagggcaccuuccacaccauguggcacgugacgcgcggggcggugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggccuguucaagaccaacaccgggacgaucggcgccgugagccuggacuucucccccggcaccagcgggucccccaucguggaccggaagggcaaggucguggggcucuacggcaacggcguggucacccgcagcggggccuacguguccgccaucgcgcagaccgagaaguccaucgaggacaaccccgagaucgaggacgacaucuuccggaagaagcgccugacgaucauggaccugcaccccggcgccgggaagaccaagcgguaccugcccgccaucgugcgcgaggccaucaagcggggccuccgcacccugauccuggccccgacccgcgucguggcggccgagauggaggaggcccuccgggggcugcccauccgcuaccagacgcccgccauccgggccgagcacaccggccgcgagaucguggaccugaugugccacgcgaccuucaccaugcggcuccugagccccguccgcgugccgaacuacaaccugaucaucauggacgaggcccacuucacggaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggcgggcaacgacaucgccgccugccuccgcaagaacggcaagaaggucauccagcugagccggaagaccuucgacuccgaguacgugaagacccgcgccaacgacugggacuucguggucacgaccgacaucagcgagaugggggccaacuuccgggcggagcgcgugaucgacccccggcgcugcaugaagcccgugauccugaccgacggcgaggagcgggucauccucgccgggcccaugccggugacccacuccagcgccgcccagcgccgcggccggaucgggcgcaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgggagaagguggacgccaucgacggggaguaccgccugcggggcgaggcccgcaagaccuucgucgaccugaugcggcgcggggaccuccccguguggcuggccuaccggguggccgcggagggcaucaacuacgccgaccgccgguggugcuucgacgggaucaagaacaaccagauccuggaggagaacgucgagguggagaucuggaccaaggagggcgagcgcaagaagcucaagccgcgguggcuggacgcccgcaucuacagcgacccccuggcccucaaggaguucaaggaguucgcggccggccggaagucccugacccugaaccucaucacggagauggggcgccugcccaccuucaugacccagaaggcccgggacgcccuggacaaccucgccguccugcacaccgcggaggccggcgggcgcgccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgccauccucacgguggucgcggccaccauggccaacgagaugggguuccuggagaagaccaagaaggaccugggccucggcagcaucaccacgcaggagagcgaguccaacauccuggacaucgaccugcgcccggccagcgccuggacccucuacgcgguggccaccaccuucgugacgcccaugcugcggcacuccaucgagaacagcuccgucaacgugagccugaccgccaucgccaaccaggcgaccgugcucauggggcugggcaagggguggccccuguccaagauggacaucggcgucccccuccuggccaucgggugcuacagccaggugaacccgaucacccugacggccgcccuccugcugcucguggcccacuacgcgaucaucggccccggccugcaggccaaggccacccgcgaggcccagaagcgcgccgcggccgggaucaugaagaaccccaccgucgacggcaucaccgugaucgaccuggagcccaucccguacgaccccaaguucgagaagcagcucggccaggugaugcugcugauccucugcgucacccaggugcugaugaugcggaccaccugggcccugugcgaggcccucacccuggccacgggccccaucuccacccugugggaggggaaccccggccgcuucuggaacaccaccaucgcggugagcauggccaacaucuuccggggcuccuaccucgccggggccggccugcuguucagcaucaugaagaacacgaccaacacccgccgggggaccggcaacaucggcgagacgcucggggagaaguggaagucccgccugaacgcgcugggcaagagcgaguuccagaucuacaagaaguccgggauccaggaggucgaccggacccucgccaaggagggcaucaagcgcggggagaccgaccaccacgccgugagccggggcuccgccaagcugcgcugguucguggagcggaacauggucaccccggagggcaaggugguggaccuggggugcggccgcgggggcuggagcuacuacugcgggggccucaagaacguccgggaggugaagggccugacgaagggcgggcccgggcacgaggagcccauccccauguccaccuacggcuggaaccuggugcgccuccagagcggggucgacguguucuucaccccgcccgagaagugcgacacccugcugugcgacaucggcgagagcucccccaaccccacgaucgaggccggccggacccuccgcgugcugaaccuggucgagaacuggcucaacaacaacacccaguucugcaucaaggugcugaacccguacaugcccagcgugaucgagaagauggagacccugcagcggaaguacgggggcgcgcugguccgcaacccccucucccggaacagcacccacgagauguacuggguguccaacgccacggggaacaucgugagcuccgucaacaugaucagccgcaugcugaucaaccgcuucaccaugaagcacaagaaggccaccuacgagccggacguggaccugggcuccgggacccggaacaucggcaucgagagcgagauccccaaccucgacaucaucggcaagcgcaucgagcggaucaagcaggagcacgagacguccuggcacuacgaccaggaccaccccuacaagaccugggccuaccacgggagcuacgagaccaagcagaccggcuccgccagcuccauggugaacggggucgugcgccugcugacgaagcccugggacguggucccgauggugacccagauggcgaugaccgacaccacgcccuucggccagcagcggguguucaaggagaaggucgacacccgcacccaggagcccaaggagggcaccaagaagcucaugcggaucacggccgaguggcuguggaaggagcuggggaagaagaagacgccccgcaugugcacccgggaggaguucacccgcaaggugcggagcaacgccgcccucggcgccguguucacggacgagaacaaguggaaguccgcgcgcgaggccgucgaggacagccgguucugggagcugguggaccgcgagcggaaccugcaccucgaggggaagugcgagaccugcgucuacaacaugaugggcaagcgcgagaagaagcugggggaguucggcaaggccaagggcucccgggccaucugguacauguggcugggggcgcgcuuccucgaguucgaggcccugggcuuccugaacgaggaccacugguucagccggcgcaacagccucuccgggguggagggcgaggggcugcaccggcugggcuacauccuccgcgacgugagcaagaaggagggcggggccauguacgccgacgacaccgccggcugggacacccgcaucacgcuggaggaccugaagaacgaggagauggucaccaaccacaugaagggggagcacaagaagcucgcggaggccaucuucaagcugaccuaccagaacaagguggugcggguccagcgcccgacgccccggggcacggugauggacaucaucucccgccgggaccagcgcgggagcggccaggugggcaccuacgggcugaacaccuucaccaacauggaggcccagcucauccggcagauggagggcgaggggaucuucaaguccauccagcaccugacggucaccgaggagaucgccgugcagaacuggcuggcccgcgugggccgggagcgccucagccggauggcgaucuccggcgacgacugcgucgugaagccccuggacgaccgcuucgccagcgcccugaccgcccucaacgacauggggaaggugcggaaggacauccagcagugggagcccucccgcggcuggaacgacuggacccaggucccguucugcagccaccacuuccacgagcuggugaugaaggacgggcgggugcuggucgugcccugccgcaaccaggacgagcucaucggccgggcccgcaucucccagggggcgggcuggagccugaaggagacggccugccugggcaaguccuacgcccagauguggacccucauguacuuccaccggcgcgaccugcgccuggccgccaacgcgaucugcagcgccgugcccucccacuggguccccaccagccggaccaccugguccauccacgccaagcacgaguggaugacgaccgaggacaugcucgccguguggaaccgcguguggauccaggagaacccguggauggaggacaagacccccgucgagagcugggaggaggugcccuaccuggggaagcgggaggaccaguggugcggcagccugaucgggcucaccucccgcgcgacgugggccaagaacauccagaccgccaucaaccaggugcggagccugaucggcaacgaggaguacaccgacuacaugcccuccaugaagcgcuuccggcgcgaggaggaggaggccgggguccugugguga

SEQ ID NO: 9396 - RNA, 9876 nt, Artificial Sequence
  derived and/or modified CDS sequence (opt1) from DENV-2__EU569709__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcgguacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgugauggccgugggcauggucagcauccuggccuccagccuccugaagaacgacauccccaugaccgggccccugguggccggcgggcuccugaccgugugcuacguccugacgggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucaccauccugauccggacgggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacccgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugagccuggacuucucccccggcacgagcgggucccccaucguggaccggaagggcaaggucguggggcuguacggcaacggcguggucacccgcagcggggccuacguguccgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucagccccguccgcgugccgaacuacaaccugaucaucauggacgaggcgcacuucaccgaccccgccuccaucgccgcccggggcuacaucagcacgcgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggccggcaacgacaucgcggccugccugcgcaagaacggcaagaaggucauccagcucagccggaagaccuucgacuccgaguacgugaagacccgcgccaacgacugggacuucguggucaccacggacaucagcgagaugggggccaacuuccgggccgagcgcgugaucgacccccggcgcugcaugaagcccgugauccugaccgacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccugagcgagcugcccgagacccucgagacgcugcugcuccugacccugcucgccaccgugaccggcggcaucuuccuguuccugauguccgggaagggcaucgggaagaugacgcucggcaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaucacccaggagagcgaguccaacauccucgacaucgaccugcgcccggccagcgccuggacccuguacgccguggccacgaccuucgucacccccaugcuccggcacuccaucgagaacagcuccgugaacgugagccugaccgcgaucgccaaccaggccacgguccugauggggcucggccgcggguggccccuguccaagauggacaucggcgugccccugcucgccaucgggugcuacagccaggugaacccgaucacccugaccgcggcccugcuccugcuggucgcccacuacgccaucaucggccccggccuccaggccaaggcgacccgcgaggcccagaagcgggccgccgccgggaucaugaagaaccccacgguggacggcaucaccgugaucgaccuggagcccaucccguacgaccccaaguucgagaagcagcuggggcaggucaugcuccuggugcugugcgugacccagguccucaugaugcgcaccacgugggcgcugugcgaggcccugacccucgccaccggccccaucuccacccugugggaggggaaccccggccgguucuggaacacgaccaucgccgugagcauggccaacaucuuccgcggcuccuaccuggcgggggccggccuccuguucagcaucaugaagaacaccaccaacacgcggcgcgggaccggcaacaucggcgagacccugggggagaaguggaagucccggcucaacgcccugggcaagagcgaguuccagaucuacaagaaguccgggauccaggagguggaccgcacccuggccaaggagggcaucaagcgcggggagacggaccaccacgcggucagccgcggcuccgccaagcuccggugguucguggagcgcaacauggugaccccggagggcaaggucguggaccuggggugcggccgcggcggguggagcuacuacugcggcgggcugaagaacgugcgcgaggucaaggggcucaccaagggcgggcccgggcacgaggagcccauccccauguccaccuacggcuggaaccuggugcggcugcagagcgggguggacgucuucuucacgccgcccgagaagugcgacacccuccugugcgacaucggcgagagcucccccaaccccaccaucgaggccggccgcacccugcgggugcucaaccugguggagaacuggcugaacaacaacacgcaguucugcaucaagguccucaacccguacaugcccagcgugaucgagaagauggagacccugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucaccaugaagcacaagaaggcgacguacgagccggacgucgaccugggcuccgggacccgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggugguccgccuccugaccaagcccugggacguggugccgauggucacccagauggccaugacggacaccacccccuucggccagcagcggguguucaaggagaagguggacacccgcacgcaggagcccaaggagggcaccaagaagcugaugcggaucaccgccgaguggcucuggaaggagcuggggaagaagaagacgccccggaugugcacgcgggaggaguucacccgcaagguccgguccaacgcggcccugggcgccaucuucaccgacgagaacaaguggaaguccgcccgcgaggccguggaggacucccgguucugggagcucgucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggggaacagccugagcggcguggagggggagggccuccacaagcugggcuacauccugcgcgacgucuccaagaaggagggcggggcgauguacgccgacgacacggccgggugggacacccggaucacccucgaggaccugaagaacgaggagauggugaccaaccacaugaagggcgagcacaagaagcuggccgaggccaucuucaagcucacguaccagaacaaggugguccgcgugcagcgcccgacgccccgggggaccgugauggacaucaucagccgcaaggaccagcggggcuccggccaggucgggaccuacggccugaacacguucaccaacauggaggcgcagcugauccgccagauggagggggagggcaucuucaagagcauccagcaccucaccgugaccgaggagaucgccgugcagaacuggcuggcccgggucggccgcgagcggcugucccgcauggccaucagcggggacgacugcguggugaagccccucgacgaccgguucgccuccgcgcugacggcccugaacgacaugggcaagguccgcaaggacauccagcagugggagcccagccggggguggaacgacuggacccaggugccguucugcucccaccacuuccacgagcucgugaugaaggacggccgcguccugguggugcccugccggaaccaggacgagcugaucgggcgcgcccggaucagccagggcgccggcuggucccucaaggagaccgccugccugggcaagagcuacgcgcagauguggacccugauguacuuccaccgccgggaccuccgccuggccgccaacgccaucugcuccgccguccccagccacugggugcccacgucccggaccaccuggagcauccacgcgaagcacgaguggaugaccaccgaggacaugcuggccguguggaaccgcgucuggauccaggagaacccguggauggaggacaagacgcccguggaguccugggaggaggugcccuaccucggcaagcgcgaggaccaguggugcgggagccugaucggccugaccagccgggccaccugggccaagaacauccagaccgcgaucaaccagguccgcucccucaucgggaacgaggaguacacggacuacaugcccagcaugaagcgguuccgcaaggaggaggaggaggccggcgugcugugguga

SEQ ID NO: 9397 - RNA, 9876 nt, Artificial Sequence
  derived and/or modified CDS sequence (opt1) from DENV-2__EU596485__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggacucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccgccgugaccggcggcaucuuccucuuccugaugagcgggaagggcaucgggaagaugacccugggcaugugcugcaucaucacggccuccauccuccugugguacgcgcagauccagccgcacuggaucgccgccagcaucauccuggaguucuuccucaucguccugcugauccccgagcccgagaagcagcggacgccccaggacaaccagcucaccuacguggugaucgccauccugaccgucguggccgcgaccauggccaacgagaugggguuccuggagaagacgaagaaggaccucggccugggcagcaucaucacccaggaguccgagagcaacauccuggacaucgaccuccgcccggccuccgccuggacccuguacgccguggcgaccacguucgucacccccaugcugcggcacagcaucgagaacuccagcgugaacgugucccucaccgccaucgccaaccaggccaccguccugauggggcugggccgcggguggccccucagcaagauggacaucggcgugccccugcuggcgaucgggugcuacucccaggugaacccgaucacgcucaccgccgcccugcugcuccuggucgcccacuacgccaucaucggccccggccugcaggcgaaggccacccgcgaggcccagaagcgggccgccgcggggaucaugaagaaccccaccguggacggcaucacggugaucgaccucgagcccaucccguacgaccccaaguucgagaagcagcuggggcaggucaugcugcucgugcugugcgugacccagguccugaugaugcgcaccaccugggcccucugcgaggcccugacgcuggccaccggccccaucagcacccucugggaggggaaccccggccgguucuggaacaccacgaucgccguguccauggcgaacaucuuccgcggcagcuaccuggccggggccggccuccucuucuccaucaugaagaacaccaccaacacccggcgcgggacgggcaacaucggcgagacccugggggagaaguggaagucccggcugaacgcccucggcaaguccgaguuccagaucuacaagaaguccgggauccaggagguggaccgcacccuggcgaaggagggcaucaagcgcggggagaccgaccaccacgccgucucccgcggcagcgccaagcugcggugguucguggagcgcaacauggugacgccggagggcaaggucguggaccucgggugcggccgcggcgggugguccuacuacugcggcgggcugaagaacgugcgcgaggucaaggggcugaccaagggcgggcccgggcacgaggagcccauccccaugagcaccuacggcuggaaccucgugcggcugcagagcgggguggacgucuucuucaccccgcccgagaagugcgacacgcugcucugcgacaucggcgaguccagccccaaccccaccaucgaggccggccgcacccugcgggugcugaaccucguggagaacuggcugaacaacaacacccaguucugcaucaagguccugaacccguacaugcccuccgugaucgagaagauggagacgcuccagcgcaaguacgggggcgcccuggugcggaacccccugagccgcaacuccacccacgagauguacugggucagcaacgcgaccgggaacaucguguccagcgugaacaugaucucccgcaugcugaucaaccgguucaccaugaagcacaagaaggccaccuacgagccggacgucgaccucggcagcgggacgcgcaacaucggcaucgagaacgagauccccaaccuggacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggugguccgccugcucaccaagcccugggacguggugccgauggucacccagauggccaugaccgacacgacccccuucggccagcagcggguguucaaggagaagguggacacccgcacccaggagcccaaggagggcacgaagaagcugaugcggaucaccgcggaguggcuguggaaggagcucgggaagaagaagacgccccggaugugcacccgggaggaguucgcccgcaagguccggagcaacgccgcccugggcgccaucuucacggacgagaacaaguggaaguccgcgcgcgaggccguggaggacagccgguucugggagcuggucgaccgcgagcggaaccuccaccuggaggggaagugcgagaccugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcguggagggggagggccugcacaagcucggcuacauccugcgcgacgucagcaagaaggagggcggcgccauguacgccgacgacaccgccgggugggacacccggaucacgcuggaggaccucaagaacgaggagauggugaccaaccacaugaagggcgagcacaagaagcuggcggaggccaucuucaagcugaccuaccagaacaaggugguccgcgugcagcgcccgacgccccgggggacggugauggacaucaucucccgcaaggaccagcggggcagcggccaggucgggaccuacggccucaacaccuucaccaacauggaggcccagcugauccgccagauggagggggagggcaucuucaaguccauccagcaccugacggugaccgaggagaucgccgugcagaacuggcucgcccgggucggccgcgagcggcugagccgcauggcgaucuccggggacgacugcguggugaagccccuggacgaccgguucgccagcgcccucaccgcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgcgggcuggagccugaaggagacggccugccucgggaaguccuacgcccagauguggacccugauguacuuccaccgccgggaccugcgccucgccgccaacgcgaucugcagcgccguccccucccacugggugcccaccagccggaccacgugguccauccacgccaagcacgaguggaugaccaccgaggacaugcuggccguguggaaccgcgucuggauccaggagaacccguggauggaggacaagacccccguggagagcugggaggaggugcccuaccugggcaagcgcgaggaccaguggugcgggagccucaucggccugaccucccgggcgacgugggccaagaacauccagaccgccaucaaccagguccgcagccugaucgggaacgaggaguacaccgacuacaugcccuccaugaagcgguuccgcaaggaggaggaggaggccggcgugcucugguga

SEQ ID NO: 9398 - RNA, 9876 nt, Artificial Sequence
  derived and/or modified CDS sequence (opt1) from DENV-2__EU569710__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaccuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccauccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcgguacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgugauggccgugggcauggucagcauccuggccuccagccuccugaagaacgacauccccaugaccgggccccugguggccggcgggcuccugaccgugugcuacguccugacgggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucaccauccugauccggacgggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacccgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugagccuggacuucucccccggcacgagcgggucccccaucguggaccggaagggcaaggucguggggcuguacggcaacggcguggucacccgcagcggggccuacguguccgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucagccccguccgcgugccgaacuacaaccugaucaucauggacgaggcgcacuucaccgaccccgccuccaucgccgcccggggcuacaucagcacgcgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggccggcaacgacaucgcggccugccugcgcaagaacggcaagaaggucauccagcucagccggaagaccuucgacuccgaguacgugaagacccgcgccaacgacugggacuucguggucaccacggacaucagcgagaugggggccaacuuccgggccgagcgcgugaucgacccccggcgcugcaugaagcccgugauccugaccgacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccugagcgagcugcccgagacccucgagacgcugcugcuccugacccugcucgccaccgugaccggcggcaucuuccuguuccugauguccgggaagggcaucgggaagaugacgcucggcaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaucacccaggagagcgaguccaacauccucgacaucgaccugcgcccggccagcgccuggacccuguacgccguggccacgaccuucgucacccccaugcuccggcacuccaucgagaacagcuccgugaacgugagccugaccgcgaucgccaaccaggccacgguccugauggggcucggccgcggguggccccuguccaagauggacaucggcgugccccugcucgccaucgggugcuacagccaggugaacccgaucacccugaccgcggcccugcuccugcuggucgcccacuacgccaucaucggccccggccuccaggccaaggcgacccgcgaggcccagaagcgggccgccgccgggaucaugaagaaccccacgguggacggcaucaccgugaucgaccuggagcccaucccguacgaccccaaguucgagaagcagcuggggcaggucaugcuccuggugcugugcgugacccagguccucaugaugcgcaccacgugggcgcugugcgaggcccugacccucgccaccggccccaucuccacccugugggaggggaaccccggccgguucuggaacacgaccaucgccgugagcauggccaacaucuuccgcggcuccuaccuggcgggggccggccuccuguucagcaucaugaagaacaccaccaacacgcggcgcgggaccggcaacaucggcgagacccugggggagaaguggaagucccggcucaacgcccugggcaagagcgaguuccagaucuacaagaaguccgggauccaggagguggaccgcacccuggccaaggagggcaucaagcgcggggagacggaccaccacgcggucagccgcggcuccgccaagcuccggugguucguggagcgcaacauggugaccccggagggcaaggucguggaccuggggugcggccgcggcggguggagcuacuacugcggcgggcugaagaacgugcgcgaggucaaggggcucaccaagggcgggcccgggcacgaggagcccauccccauguccaccuacggcuggaaccuggugcggcugcagagcgggguggacgucuucuucacgccgcccgagaagugcgacacccuccugugcgacaucggcgagagcucccccaaccccaccaucgaggccggccgcacccugcgggugcucaaccugguggagaacuggcugaacaacaacacgcaguucugcaucaagguccucaacccguacaugcccagcgugaucgagaagauggagacccugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucaccaugaagcacaagaaggcgacguacgagccggacgucgaccugggcuccgggacccgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggugguccgccuccugaccaagcccugggacguggugccgauggucacccagauggccaugacggacaccacccccuucggccagcagcggguguucaaggagaagguggacacccgcacgcaggagcccaaggagggcaccaagaagcugaugcggaucaccgccgaguggcucuggaaggagcuggggaagaagaagacgccccggaugugcacgcgggaggaguucacccgcaagguccgguccaacgcggcccugggcgccaucuucaccgacgagaacaaguggaaguccgcccgcgaggccguggaggacucccgguucugggagcucgucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggggaacagccugagcggcguggagggggagggccuccacaagcugggcuacauccugcgcgacgucuccaagaaggagggcggggcgauguacgccgacgacacggccgggugggacacccggaucacccucgaggaccugaagaacgaggagauggugaccaaccacaugaagggcgagcacaagaagcuggccgaggccaucuucaagcucacguaccagaacaaggugguccgcgugcagcgcccgacgccccgggggaccgugauggacaucaucagccgcaaggaccagcggggcuccggccaggucgggaccuacggccugaacacguucaccaacauggaggcgcagcugauccgccagauggagggggagggcaucuucaagagcauccagcaccucaccgugaccgaggagaucgccgugcagaacuggcuggcccgggucggccgcgagcggcugucccgcauggccaucagcggggacgacugcguggugaagccccucgacgaccgguucgccuccgcgcugacggcccugaacgacaugggcaagguccgcaaggacauccagcagugggagcccagccggggguggaacgacuggacccaggugccguucugcucccaccacuuccacgagcucgugaugaaggacggccgcguccugguggugcccugccggaaccaggacgagcugaucgggcgcgcccggaucagccagggcgccggcuggucccucaaggagaccgccugccugggcaagagcuacgcgcagauguggacccugauguacuuccaccgccgggaccuccgccuggccgccaacgccaucugcuccgccguccccagccacugggugcccacgucccggaccaccuggagcauccacgcgaagcacgaguggaugaccaccgaggacaugcuggccguguggaaccgcgucuggauccaggagaacccguggauggaggacaagacgcccguggaguccugggaggaggugcccuaccucggcaagcgcgaggaccaguggugcgggagccugaucggccugaccagccgggccaccugggccaagaacauccagaccgcgaucaaccagguccgcucccucaucgggaacgaggaguacacggacuacaugcccagcaugaagcgguuccgcaaggaggaggaggaggccggcgugcugugguga

SEQ ID NO: 9399 - RNA, 9876 nt, Artificial Sequence
  derived and/or modified CDS sequence (opt1) from DENV-2__EU596486__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcgguacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgugauggccgugggcauggucagcauccuggccuccagccuccugaagaacgacauccccaugaccgggccccugguggccggcgggcuccugaccgugugcuacguccugacgggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucaccauccugauccggacgggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacccgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugagccuggacuucucccccggcacgagcgggucccccaucguggaccggaagggcaaggucguggggcuguacggcaacggcguggucacccgcagcggggccuacguguccgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucagccccguccgcgugccgaacuacaaccugaucaucauggacgaggcgcacuucaccgaccccgccuccaucgccgcccggggcuacaucagcacgcgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggccggcaacgacaucgcggccugccugcgcaagaacggcaagaaggucauccagcucagccggaagaccuucgacuccgaguacgugaagacccgcgccaacgacugggacuucguggucaccacggacaucagcgagaugggggccaacuuccgggccgagcgcgugaucgacccccggcgcugcaugaagcccgugauccugaccgacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccugagcgagcugcccgagacccucgagacgcugcugcuccugacccugcucgccaccgugaccggcggcaucuuccuguuccugauguccgggaagggcaucgggaagaugacgcucggcaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaucacccaggagagcgaguccaacauccucgacaucgaccugcgcccggccagcgccuggacccuguacgccguggccacgaccuucgucacccccaugcuccggcacuccaucgagaacagcuccgugaacgugagccugaccgcgaucgccaaccaggccacgguccugauggggcucggccgcggguggccccuguccaagauggacaucggcgugccccugcucgccaucgggugcuacagccaggugaacccgaucacccugaccgcggcccugcuccugcuggucgcccacuacgccaucaucggccccggccuccaggccaaggcgacccgcgaggcccagaagcgggccgccgccgggaucaugaagaaccccacgguggacggcaucaccgugaucgaccuggagcccaucccguacgaccccaaguucgagaagcagcuggggcaggucaugcuccuggugcugugcgugacccagguccucaugaugcgcaccacgugggcgcugugcgaggcccugacccucgccaccggccccaucuccacccugugggaggggaaccccggccgguucuggaacacgaccaucgccgugagcauggccaacaucuuccgcggcuccuaccuggcgggggccggccuccuguucagcaucaugaagaacaccaccaacacgcggcgcgggaccggcaacaucggcgagacccugggggagaaguggaagucccggcucaacgcccugggcaagagcgaguuccagaucuacaagaaguccgggauccaggagguggaccgcacccuggccaaggagggcaucaagcgcggggagacggaccaccacgcggucagccgcggcuccgccaagcuccggugguucguggagcgcaacauggugaccccggagggcaaggucguggaccuggggugcggccgcggcggguggagcuacuacugcggcgggcugaagaacgugcgcgaggucaaggggcucaccaagggcgggcccgggcacgaggagcccauccccauguccaccuacggcuggaaccuggugcggcugcagagcgggguggacgucuucuucacgccgcccgagaagugcgacacccuccugugcgacaucggcgagagcucccccaaccccaccaucgaggccggccgcacccugcgggugcucaaccugguggagaacuggcugaacaacaacacgcaguucugcaucaagguccucaacccguacaugcccagcgugaucgagaagauggagacccugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucaccaugaagcacaagaaggcgacguacgagccggacgucgaccugggcuccgggacccgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggugguccgccuccugaccaagcccugggacgugaucccgauggugacccagauggccaugacggacaccacccccuucggccagcagcgggucuucaaggagaagguggacacccgcacgcaggagcccaaggagggcaccaagaagcugaugcggaucaccgccgaguggcucuggaaggagcuggggaagaagaagacgccccggaugugcacgcgggaggaguucacccgcaaggugcgguccaacgcggcccugggcgccaucuucaccgacgagaacaaguggaaguccgcccgcgaggccgucgaggacucccgguucugggagcucguggaccgcgagcggaaccugcaccuggaggggaagugcgagaccugcgucuacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggggaacagccugagcggcguggagggggagggccuccacaagcugggcuacauccugcgcgacguguccaagaaggagggcggcgcgauguacgccgacgacacggccgggugggacacccggaucacccucgaggaccugaagaacgaggagauggucaccaaccacaugaagggcgagcacaagaagcuggccgaggccaucuucaagcucacguaccagaacaagguggugcgcguccagcgcccgacgccccgggggaccgugauggacaucaucagccgcaaggaccagcggggcuccggccagguggggaccuacggccugaacacguucaccaacauggaggcgcagcugauccgccagauggagggggagggcaucuucaagagcauccagcaccucaccgucaccgaggagaucgccgugcagaacuggcuggcccgggugggccgcgagcggcugucccgcauggccaucagcggggacgacugcgucgugaagccccucgacgaccgguucgccuccgcgcugacggcccugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggagccaggacgagcugaucgggcgcgcccggaucucccagggcgccggcuggagccucaaggagaccgccugccuggggaaguccuacgcgcagauguggacccugauguacuuccaccgccgggaccuccgccuggccgccaacgccaucugcagcgccgugcccucccacuggguccccacgagccggaccaccugguccauccacgcgaagcacgaguggaugaccaccgaggacaugcuggccguguggaaccgcguguggauccaggagaacccguggauggaggacaagacgcccgucgagagcugggaggaggugcccuaccucggcaagcgcgaggaccaguggugcgggagccugaucggccugaccucccgggccaccugggccaagaacauccagaccgcgaucaaccaggugcgcagccucaucgggaacgaggaguacaucgacuacaugcccuccaugaagcgguuccgcaaggaggaggaggaggccggcguccugugguga

SEQ ID NO: 9400 - RNA, 9876 nt, Artificial Sequence
  derived and/or modified CDS sequence (opt1) from DENV-2__EU687212__SS-prME
accgcgggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucaucaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccaggucuucggcgcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaaguccuucgccgggcccgugagccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccuccgggaagcucaucacggaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacccgcgucggcacgaagcacgcgauccugcucguggccguguccuucgucacccugaucaccgggaacaugagcuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccuccaaggagcugaugauggccacgaucggcaucgcccugcucagccaguccaccaugcccgagaccauccuggagcugaccgacgcgcucgcccuggggaugaugguccugaagaucgugcgcaacauggagaaguaccagcucgccgugacgaucauggccaucagcugcgucccgaacgccgugauccugcagaacgcguggaagguguccugcaccauccuggccaccgucagcgugagcccccuccugcugaccagcucccagcagaaggccgacuggaucccccucgcccugacgaucaagggccugaaccccaccgcgaucuuccucaccacccugagccggacguccaagaagcgcagcuggccgcugaacgaggccaucauggccgucggcaugguguccauccucgccagcagccugcugaagaacgacauccccaugaccgggccccucguggccggcgggcugcugaccgucugcuacgugcucaccggccgguccgcggaccuggagcuggagcgcgccgccgacgugaagugggaggaccaggccgagaucagcggguccagccccauccucuccaucacgaucagcgaggacggcuccaugagcaucaagaacgaggaggaggagcagacccugaccauccugauccggaccggccuccuggucaucuccgggguguucccggugagcauccccaucaccgccgcggccugguaccugugggaggucaagaagcagcgcgccggcgugcucugggacgugcccagcccgccgcccgucgagaaggccgagcuggaggacggggccuaccggaucaagcagcgcggcauccugggguacagccagaucggcgcgggcguguacaaggaggggacguuccacaccauguggcacgugacccggggcgccguccucaugcaccgcgggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggaucuucaagacgaacaccggcaccaucggggcggugucccuggacuucagccccggcaccuccggcagccccaucgucgaccggaaggggaagguggugggccucuacgggaacggcgucgugacgcgcuccggcgccuacgugagcgccaucgcccagaccgagaaguccaucgaggacaaccccgagaucgaggacgacaucuuccggaagaagcgccugaccaucauggaccugcaccccggggcgggcaagaccaagcgguaccuccccgccaucguccgcgaggccaucaagcgggggcugcgcacgcugauccuggccccgacccgcgugguggccgcggagauggaggaggcccuccggggccugcccauccgcuaccagacccccgccauccgggccgagcacaccgggcgcgagaucgucgaccugaugugccacgccacguucaccaugcggcuccugucccccgugcgcgugccgaacuacaaccugaucaucauggacgaggcgcacuucaccgaccccgccagcaucgccgcccggggcuacaucuccacccgcgucgagaugggcgaggccgcggggaucuucaugacggccacgccgcccggcagccgggacccguucccccaguccaacgcccccaucauggacgaggagcgcgagauccccgagcggagcuggaacuccgggcacgagugggugaccgacuucaagggcaagaccgugugguucgucccgagcaucaaggccgggaacgacaucgcggccugccuccgcaagaacggcaagaaggugauccagcugucccggaagacguucgacagcgaguacgugaagacccgcgccaacgacugggacuucgucgugaccaccgacaucuccgagaugggcgccaacuucaaggccgagcgggugaucgacccccgccggugcaugaagcccgucauccugacggacggggaggagcgcgugauccucgcgggccccaugccggugacccacagcuccgccgcccagcggcgcgggcgcaucggccggaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgcgagaaggucgacgcgaucgacggcgaguaccggcugcgcggggaggcccggaagaccuucguggaccugaugcgccggggcgaccuccccguguggcuggccuacaaggucgccgccgaggggaucaacuacgcggaccgcaaguggugcuucgacggcaucaagaacaaccagauccuggaggagaacguggagguggagaucuggacgaaggagggggagcggaagaagcucaagccgcgcuggcuggacgcccggaucuacuccgacccccuggcccucaaggaguucaaggaguucgccgcgggccgcaagagccugacccugaaccucaucaccgagaugggccggcugcccaccuucaugacgcagaaggcccgcaacgcccuggacaaccucgccguccugcacaccgccgaggccgggggccgggccuacaaccacgcccuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcgcagauccagccgcacuggaucgccgccagcaucauccuggaguucuuccugaucguccuccugauccccgagcccgagaagcagcgcacgccccaggacaaccagcugaccuacguggugaucgccauccucaccgucguggccgcgaccauggccaacgagaugggcuuccuggagaagacgaagaaggaccuggggcucggcagcaucaccacccaggaguccgagagcaacauccuggacaucgaccugcggccggccuccgccuggacccucuacgccguggcgacgaccuucgucacccccaugcugcgccacagcaucgagaacuccagcgugaacgugucccugaccgccaucgccaaccaggccacgguccucaugggccuggggaagggcuggccccugagcaagauggacaucggggugccccuccuggcgaucggcugcuacucccaggugaacccgaucacccugaccgccgcccuccugcugcucgucgcccacuacgccaucaucgggcccggccugcaggcgaaggccacccgggaggcccagaagcgcgccgccgcgggcaucaugaagaaccccacgguggacgggaucaccgugaucgaccuggagcccaucccguacgaccccaaguucgagaagcagcucggccaggucaugcugcugauccucugcgugacccaggugcugaugaugcggaccacgugggcccugugcgaggcccucacccuggccaccgggcccaucagcacccugugggagggcaaccccgggcgcuucuggaacacgaccaucgccgucuccauggcgaacaucuuccgcggcagcuaccucgccggcgccgggcugcuguucuccaucaugaagaacaccaccaacacgcggcgcggcaccgggaacaucggcgagacccucggcgagaaguggaagucccggcugaacgcccuggggaaguccgaguuccagaucuacaagaaguccggcauccaggagguggaccgcacccucgcgaaggaggggaucaagcggggcgagacggaccaccacgccgugucccgcgggagcgccaagcugcggugguucgucgagcgcaacauggugaccccggagggcaagguggucgaccugggcugcgggcggggcgggugguccuacuacugcggcgggcucaagaacgugcgcgaggugaagggccugaccaagggcgggcccggccacgaggagcccguccccaugagcaccuacggguggaaccuggugcggcuccagagcggcguggacgucuucuucacgccgcccgagaagugcgacacccugcugugcgacaucggggaguccagccccaaccccaccaucgaggccggccgcacccuccgggugcugaaccugguggagaacuggcucaacaacaacacccaguucugcaucaagguccugaacccguacaugcccuccgugaucgagaagauggagacgcugcagcgcaaguacggcggggcccucgugcggaacccccugagccgcaacuccacccacgagauguacugggucagcaacgcgaccggcaacaucguguccagcgugaacaugaucucccggaugcugaucaaccgcuucaccaugaagcacaagaaggccacguacgagccggacgucgaccuggggagcggcacccggaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcugaccaagcccugggacguggugccgauggucacccagauggccaugacggacaccacccccuucgggcagcagcggguguucaaggagaagguggacacccgcacgcaggagcccaaggagggcaccaagaagcucaugaagaucaccgcggaguggcuguggaaggagcugggcaagaagaagacgccccggaugugcacgcgcgaggaguucaccaagaagguccgguccaacgccgcccucggggccaucuucaccgacgagaacaaguggaaguccgcccgcgaggcgguggaggacggccgguucugggagcugguggaccgcgagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggggaacagccucuccggcguggagggggagggccugcaccgccugggcuacauccuccgggaggucgggaagaaggagggcggggccauguacgccgacgacacggccggcugggacacccgcaucacccuggaggaccugaagaacgaggagauggugaccaaccacaugaagggggagcacaagaagcucgccgaggcgaucuucaagcugacguaccagaacaaggugguccgggugcagcgcccgacgccccggggcaccgugauggacaucaucagccgccgggaccagcgcggcuccgggcaggucggcaccuacgggcugaacacguucaccaacauggaggcccagcucauccgccagauggagggcgagggcaucuucaagagcauccagcaccugaccgccaccgaggagaucgccgugcagaacuggcuggcccggguggggcgcgagcggcucucccgcauggcgaucagcggcgacgacugcgucgugaagcccaucgacgaccgguucgccuccgcccugacggcccugaacgacauggggaaggugcgcaaggacauccagcagugggagcccagccggggcuggaacgacuggacccaggucccguucugcucccaccacuuccacgagcucgugaugaaggacgggcgcgugcuggucgugcccugccggaaccaggacgagcugaucggccgcgcccggaucagccagggcgcgggguggucccucaaggagaccgccugccugggcaagagcuacgcccagauguggacccugauguacuuccaccgccgggaccuccgccuggccgccaacgcgaucugcuccgccgugcccagccacuggguccccaccucccggacgaccuggagcauccacgccaagcacgaguggaugaccaccgaggacaugcuggccguguggaaccgcguguggauccaggagaacccguggauggaggacaagacgcccgucgaguccugggaggaggugcccuaccucgggaagcgggaggaccaguggugcggcagccugaucgggcugaccagccgcgcgaccugggccaagaacauccagaccgccaucaaccaggugcggucccucaucggcaacgaggaguacacggacuacaugcccagcaugaagcgcuuccgccgggaggaggaggaggccggcguccugugguga

SEQ ID NO: 9401 - RNA, 9876 nt, Artificial Sequence
  derived and/or modified CDS sequence (opt1) from DENV-2__EU660400__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccaccguggcccccagcaugaccaugcgcugcaucggcaucuccaaccgggacuucguggagggcgucagcgggggcuccuggguggacaucgugcucgagcacgggagcugcgucaccaccauggcgaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaaggucgugcugcccgagaaccuggaguacacgaucgugaucacgccccacagcggggaggagcacgcggucggcaacgacaccgggaagcacggcaaggagaucaagaucaccccgcaguccagcaucaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgccaagaagcaggacguggucgugcuggggucccaggagggcgcgaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagacgaccaugcgcggcgcgaagcggauggccauccugggggacaccgccugggacuucggcagccucgggggcguguucaccuccaucgggaaggcccugcaccaggucuucggcgccaucuacggcgcggccuucagcgggguguccuggacgaugaagauccugaucggcgugaucaucaccuggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucacggacaacguccacaccuggaccgagcaguacaaguuccagcccgagagccccagcaagcuggccuccgcgauccagaaggcccacgaggagggcaucugcgggauccggagcgugacccgccucgagaaccugauguggaagcagaucacgcccgagcugaaccacauccucuccgagaacgaggugaagcugaccaucaugaccggcgacaucaaggggaucaugcaggccggcaagcggagccugcgcccgcagcccaccgagcucaaguacuccuggaagacguggggcaaggccaagaugcugagcaccgagucccacaaccagaccuuccugaucgacgggcccgagaccgccgagugcccgaacacgaaccgggcguggaacagccucgaggucgaggacuacggcuucgggguguucuccaccaacaucuggcugaagcugcgcgagaagcaggacguguucugcgacagcaagcucauguccgccgccaucaaggacaaccgggccguccacgccgacaugggcuacuggaucgagagcgcgcugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggugaacucccucgugaccgcggggcacggccagaucgacaacuucagccugggcguccuggggauggcccucuuccuggaggagaugcugcggacccgcgugggcaccaagcacgccauccuccugguggccgucuccuucgugacgcugaucaccgggaacaugagcuuccgggaccucggccgcgugauggucauggugggggcgaccaugaccgacgacaucggcaugggcgugacguaccuggcccugcucgccgccuucaagguccgccccaccuucgccgcggggcugcugcuccggaagcugaccuccaaggagcugaugauggccaccaucggcaucgcccuccugagccaguccacgauccccgagaccauccuggagcucaccgacgcccuggcccuggggaugauggugcucaagaucgugcgcaacauggagaaguaccagcuggcggucaccaucauggccaucagcugcgugccgaacgccgugauccugcagaacgccuggaaggucuccugcacgauccucgccgcggugagcgucagcccccugcugcucaccagcucccggcagaaggccgacuggaucccccuggcccugaccaucaagggccucaaccccaccgccaucuuccugacgacccugagccgcaccuccaagaagcggagcuggccgcucaacgaggcggugauggccgugggcauggucuccauccuggccagcagccugcucaagaacgacauccccaugaccgggccccugguggccggcgggcugcucacggugugcuacguccugaccggccgcuccgccgaccuggagcucgagcgggcggccgacgugaagugggaggaccaggccgagaucagcggguccagccccauccuguccaucaccaucagcgaggacggcuccaugagcaucaagaacgaggaggaggagcacacccugacgauccucauccgcaccggccugcuggugaucuccggggucuucccggugagcauccccaucaccgccgccgcgugguaccucugggaggugaagaagcagcgggccggcguccugugggacgugcccagcccgccgcccguggggaaggccgagcuggaggacggcgccuaccgcaucaagcagcgggggaucuucggcuacagccagaucggcgccggggucuacaaggagggcaccuuccacaccauguggcacgugacgcgcggggcggugcucaugcaccggggcaagcgcaucgagcccuccugggccgacgucaagaaggaccugaucagcuacgggggcggcuggaagcuggagggggaguggaaggagggcgaggagguccaggugcucgcccuggagcccgggaagaacccccgggccguccagaccaagcccggccuguucaagaccaacaccgggacgaucggcgccgugucccucgacuucagccccggcaccuccgggagccccaucguggaccgcaagggcaaggucguggggcuguacggcaacggcguggucacccgguccggggcguacgugagcgccaucgcccagaccgagaaguccaucgaggacaaccccgagaucgaggacgacaucuuccgcaagaagcggcugacgaucauggaccuccaccccggcgccgggaagaccaagcgcuaccugcccgcgaucgugcgggaggccaucaagcgcggccugcgcacccugauccucgccccgacccgggucguggccgccgagauggaggaggcgcugcgcgggcugcccauccgguaccagacgcccgccauccgcgccgagcacaccggccgggagaucguggaccucaugugccacgccaccuucaccaugcgccugcugucccccguccgggugccgaacuacaaccucaucaucauggacgaggcccacuucacggaccccgcgagcaucgccgcccgcggcuacaucuccacccggguggagaugggggaggccgccggcaucuucaugaccgcgacgccgcccgggagccgcgacccguucccccaguccaacgcccccaucauggacgaggagcgggagauccccgagcgcagcuggaacuccggccacgagugggucacggacuucaaggggaagaccgugugguucgugccgagcaucaaggccggcaacgacaucgccgcgugccugcggaagaacggcaagaaggucauccagcugucccgcaagaccuucgacagcgaguacgugaagacccgggccaacgacugggacuucguggucacgaccgacaucuccgagaugggggccaacuuccgcgccgagcgggugaucgacccccgccggugcaugaagcccgugauccucaccgacggcgaggagcgcgucauccuggccgggcccaugccggugacccacagcuccgcggcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgccaucgacggggaguaccggcugcgcggcgaggcgcggaagaccuucgucgaccucaugcgccgcggggaccugcccguguggcuggccuaccgcguggccgccgagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcgcggaucuacuccgacccccucgcccugaaggaguucaaggaguucgccgccggccgcaagagccugacccucaaccugaucacggagauggggcggcugcccaccuucaugacccagaaggcgcgcgacgcccucgacaaccuggccguccugcacaccgccgaggugggcgggcgggccuacaaccacgcgcucuccgagcugcccgagacgcuggagacccuccugcugcucacccugcuggccaccgugacgggcggcaucuuccucuuccugaugagcgggaagggcaucgggaagaugacccugggcaugugcugcaucaucaccgccuccauccuccugugguacgcccagauccagccgcacuggaucgccgcgagcaucauccuggaguucuuccucaucguccugcugauccccgagcccgagaagcagcgcacgccccaggacaaccagcucaccuacguggugaucgccauccugacggucguggccgccaccauggccaacgagaugggguuccuggagaagaccaagaaggaccucggccugggcagcaucaccacgcaggaguccgagagcaacauccuggacaucgaccuccggccggcguccgccuggacccuguacgccguggccaccaccuucgucacgcccaugcugcgccacagcaucgagaacuccagcgugaacgugucccucaccgccaucgcgaaccaggccaccguccugauggggcugggccgcggguggccccucagcaagauggacaucggcgugccccugcuggccaucgggugcuacucccaggugaacccgaucacccucacggccgcgcugcugcuccuggucgcccacuacgccaucaucggccccggccugcaggccaaggccacccgggaggcgcagaagcgcgccgccgccgggaucaugaagaaccccaccguggacggcaucaccgugaucgaccucgagcccaucccguacgaccccaaguucgagaagcagcuggggcaggucaugcugcucgugcugugcgugacgcagguccugaugaugcggaccaccugggcccucugcgaggcgcugacccuggccacgggccccaucagcacccucugggaggggaaccccggccgcuucuggaacaccaccaucgccguguccauggccaacaucuuccggggcagcuaccuggccggggcgggccuccucuucuccaucaugaagaacacgaccaacacccgccgggggaccggcaacaucggcgagacgcugggggagaaguggaagucccgccugaacgcccucggcaaguccgaguuccagaucuacaagaaguccgggauccaggagguggaccggacccuggccaaggagggcaucaagcgcggggagaccgaccaccacgccgucucccggggcagcgcgaagcugcgcugguucguggagcggaacauggugaccccggagggcaaggucguggaccucgggugcggccgcgggggcugguccuacuacugcgggggccugaagaacgugcgggaggucaagggccugacgaagggcgggcccgggcacgaggagcccauccccaugagcaccuacggcuggaaccucgugcgccugcagagcgggguggacgucuucuucaccccgcccgagaagugcgacacccugcucugcgacaucggcgaguccagccccaaccccacgaucgaggccggccggacccugcgcgugcugaaccucguggagaacuggcugaacaacaacacccaguucugcaucaagguccugaacccguacaugcccuccgugaucgagaagauggagacccuccagcggaaguacgggggcgcccuggugcgcaacccccugagccgcaacuccacccacgagauguacugggucagcaacgccacggggaacaucguguccagcgugaacaugaucucccggaugcugaucaaccgcuucaccaugaagcacaagaaggccaccuacgagccggacgucgaccucggcagcgggacccggaacaucggcaucgagaacgagauccccaaccuggacaucaucggcaagcgcaucgagaagaucaagcaggagcacgagacguccuggcacuacgaccaggaccaccccuacaagaccugggcguaccacgggagcuacgagaccaagcagaccggcuccgccagcuccauggugaacgggguggucaagcugcucacgaagcccugggacguggugccgauggucacccagauggccaugaccgacaccacgcccuucggccagcagcggguguucaaggagaagguggacacccgcacccaggagcccaaggagggcaccaagaagcugaugcggaucacggccgaguggcuguggaaggagcucgggaagaagaagacgccccgcaugugcacccgggaggaguucacccgcaagguccggagcaacgccgcgcugggcgccaucuucacggacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggggccauguacgcggacgacaccgccgggugggacacccggaucacgcuggaggaccucaagaacgaggagauggugaccaaccacaugaagggcgagcacaagaagcuggccgaggccaucuucaagcugaccuaccagaacaaggugguccgcgugcagcgcccgacgccccgggggacggugauggacaucaucucccgcaaggaccagcggggcagcggccaggucgggaccuacggccucaacaccuucaccaacauggaggcccagcugauccgccagauggagggggagggcaucuucaaguccauccagcggcugacggugaccgaggagaucgcggugcagaacuggcucgcccgcgucggccgggagcgccugagccggauggccaucuccggggacgacugcguggugaagccccuggacgaccgcuucgccagcgcccucaccgcgcugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagacggccugccucgggaaguccuacgcccagauguggacccugauguacuuccaccggcgcgaccugcggcucgcggccaacgccaucugcagcgccguccccucccacugggugcccaccagccgcaccaccugguccauccacgccaagcacgaguggaugacgaccgaggacaugcuggcgguguggaaccgcgucuggauccaggagaacccguggauggaggacaagacccccguggagagcugggaggaggugcccuaccugggcaagcgggaggaccaguggugcgggagccucaucggccugaccucccgcgccacgugggccaagaacauccagaccgccaucaaccagguccggagccugaucgggaacgaggaguacaccgacuacaugcccuccaugaagcgcuuccggaaggaggaggaggaggcgggcgugcucugguga

SEQ ID NO: 9402 - RNA, 9876 nt, Artificial Sequence
  derived and/or modified CDS sequence (opt1) from DENV-2__EU569711__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacauccuggggcgccugaucaccgucaacccgaucgugaccgagaaggacagccccgugaacaucgaggcggagccgcccuucggcgacuccuacaucaucaucggggucgagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccagguguucggcgcgaucuacggcgccgccuucagcggggucuccuggaccaugaagauccugaucggcgugaucaucacguggaucgggaugaacagccgcuccaccagccuguccgugagccucguccuggugggcguggucacccuguaccucggggugauggugcaggccgacuccggcugcgucgugagcuggaagaacaaggagcugaagugcggcuccgggaucuucaucaccgacaacgugcacacguggaccgagcaguacaaguuccagcccgagagccccagcaagcuggcguccgccauccagaaggcccacgaggagggcaucugcgggauccggagcgucacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgagguggaggacuacggcuucggggucuucuccacgaacaucuggcugaagcugcgcgagaagcaggacguguucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcgggccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcacgaccugggcgcucugcgaggcccugacccuggccaccggccccaucagcacgcucugggaggggaaccccggccgguucuggaacaccaccaucgccgucuccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggugucccgcggcagcgccaagcugcggugguucgucgagcgcaacauggugaccccggagggcaagguggucgaccucgggugcggccgcggcgggugguccuacuacugcggcgggcugaagaacgugcgcgaggugaaggggcugaccaagggcgggcccgggcacgaggagcccauccccaugagcacguacggcuggaaccucguccggcugcagagcgggguggacguguucuucaccccgcccgagaagugcgacacccugcucugcgacaucggcgaguccagccccaaccccaccaucgaggccggccgcacgcugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccaccgggaacaucgucuccagcgugaacaugaucucccgcaugcugaucaaccgguucacgaugaagcacaagaaggcgaccuacgagccggacguggaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggucaacgggguggugcgccugcucaccaagcccugggacgucgugccgauggugacgcagauggccaugaccgacaccacccccuucggccagcagcgggucuucaaggagaagguggacacgcgcacccaggagcccaaggagggcaccaagaagcugaugcggaucaccgccgaguggcuguggaaggagcucgggaagaagaagacgccccgcaugugcacccgggaggaguucacccgcaaggugcggagcaacgcggcccugggcgccaucuucaccgacgagaacaaguggaaguccgcccgcgaggccgucgaggacagccgguucugggagcugguggaccgcgagcggaaccuccaccuggaggggaagugcgagacgugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgugagcaagaaggagggcggggcgauguacgccgacgacaccgccgggugggacacccggaucacccuggaggaccucaagaacgaggagauggucacgaaccacaugaagggcgagcacaagaagcuggccgaggccaucuucaagcugaccuaccagaacaagguggugcgcguccagcgcccgacgccccgggggaccgugauggacaucaucucccgcaaggaccagcggggcagcggccagguggggacguacggccucaacaccuucaccaacauggaggcgcagcugauccgccagauggagggggagggcaucuucaaguccauccagcggcugaccgucacggaggagaucgccgugcagaacuggcucgcccgcgugggccgggagcgccugagccggauggccaucuccggggacgacugcgucgugaagccccuggacgaccgcuucgccagcgcgcucaccgcccugaacgacaugggcaaggugcggaaggacauccagcagugggagcccucccgcggguggaacgacuggacccaggucccguucugcagccaccacuuccacgagcuggugaugaaggacggccgggugcucgucgugcccugccgcaaccaggacgagcugaucgggcgggcccgcaucucccagggcgccggcuggagccugaaggagaccgccugccucgggaaguccuacgcgcagauguggacgcugauguacuuccaccggcgcgaccugcggcucgccgccaacgccaucugcagcgccgugcccucccacuggguccccaccagccgcaccaccugguccauccacgcgaagcacgaguggaugaccacggaggacaugcuggccguguggaaccgcguguggauccaggagaacccguggauggaggacaagacccccgucgagagcugggaggaggugcccuaccugggcaagcgggaggaccaguggugcgggagccucaucggccugaccucccgcgccaccugggccaagaacauccagacggcgaucaaccaggugcggagccugaucgggaacgaggaguacaccgacuacaugcccuccaugaagcgcuuccggaaggaggaggaggaggccggcguccucugguga

SEQ ID NO: 9403 - RNA, 9876 nt, Artificial Sequence
  derived and/or modified CDS sequence (opt1) from DENV-2__EU569712__SS-prME
accgccgggaugaucaucaugcugauccccaccgccauggcguuccaccucaccacccgcaacggggagccccacaugaucguggggcggcaggagaaggggaagucccugcuguucaagaccgaggacggcgucaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacccacuuccagcgggcccucaucuucauccugcugaccgccgucgcgcccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcggccucuucggcaagggcgggaucgugaccugcgcgauguucacgugcaagaagaacauggagggcaaggugguccugcccgagaaccuggaguacaccaucgugaucacgccccacagcggggaggagcacgccgugggcaacgacaccgggaagcacggcaaggagaucaagaucaccccgcaguccagcaucaccgaggccgagcucaccggguacggcacggucaccauggagugcagcccccggaccggccuggacuucaacgagauggugcugcuccagauggaggacaaggccuggcuggugcaccggcagugguuccuggaccucccccugcccuggcugccgggggccgacacccagggcagcaacuggauccagaaggagacgcucgucaccuucaagaacccccacgcgaagaagcaggacguggugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccucgagaagcgguacgugcuggggcgccugaucaccgucaacccgaucgugaccgagaaggacagccccgugaacaucgaggcggagccgcccuucggcgacuccuacaucaucaucggggucgagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccagguguucggcgcgaucuacggcgccgccuucagcggggucuccuggaccaugaagauccugaucggcgugaucaucacguggaucgggaugaacagccgcuccaccagccuguccgugagccucguccuggugggcguggucacccuguaccucggggugauggugcaggccgacuccggcugcgucgugagcuggaagaacaaggagcugaagugcggcuccgggaucuucaucaccgacaacgugcacacguggaccgagcaguacaaguuccagcccgagagccccagcaagcuggcguccgccauccagaaggcccacgaggagggcaucugcgggauccggagcgucacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgagguggaggacuacggcuucggggucuucuccacgaacaucuggcugaagcugcgcgagaagcaggacguguucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccauccugugcgucccgaacgccgugauccuccagaacgccuggaaggugagcugcaccauccuggcggccgucuccgugagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgucauggccgugggcauggugagcauccuggccuccagccuccugaagaacgacauccccaugaccgggccccuggucgccggcgggcuccugaccgugugcuacgugcugacgggccggagcgcggaccucgagcuggagcgcgccgccgacgucaagugggaggaccaggccgagaucuccgggagcucccccauccugagcaucaccaucuccgaggacggcagcauguccaucaagaacgaggaggaggagcagacccucaccauccugauccggacgggccugcucgugaucagcgggguguucccggucuccauccccaucaccgccgcggccugguaccugugggaggugaagaagcagcgcgccggcgugcugugggacguccccagcccgccgcccguggagaaggccgagcucgaggacggggccuaccggaucaagcagcgcggcaucuucggguacucccagaucggcgcgggcguguacaaggaggggaccuuccacaccauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgccgugcagacgaagcccggccucuucaagaccaacaccggcaccaucggggcggucagccuggacuucucccccggcacgagcggcucccccaucguggaccggaaggggaagguggucggccuguacgggaacggcguggugacccgcagcggcgccuacgucuccgccaucgcccagaccgagaaguccaucgaggacaaccccgagaucgaggacgacaucuuccggaagaagcgccucaccaucauggaccugcaccccggggcgggcaagacgaagcgguaccugcccgccaucgugcgcgaggccaucaagcgggggcugcgcacccucauccuggccccgacccgcguggucgccgcggagauggaggaggcccugcggggccuccccauccgcuaccagacccccgccauccgggccgagcacacggggcgcgagaucguggaccugaugugccacgccaccuucaccaugcggcugcucagccccgugcgcgucccgaacuacaaccugaucaucauggacgaggcgcacuucaccgaccccgccuccaucgccgcccggggcuacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggucugguucgugccguccaucaaggccgggaacgacaucgcggccugccugcgcaagaacggcaagaaggugauccagcucagccggaagaccuucgacuccgaguacgucaagacccgcgccaacgacugggacuucguggugaccacggacaucagcgagaugggcgccaacuuccgggccgagcgcgucaucgacccccggcgcugcaugaagcccgugauccugaccgacggggaggagcgggugauccuggcgggccccaugccggucacccacuccagcgccgcccagcgccgcgggcggaucggccgcaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgggagaagguggacgcgaucgacggcgaguaccgccuccgcggggaggcccgcaagacguucguggaccugaugcggcgcggcgaccugcccgucuggcucgccuaccggguggccgccgaggggaucaacuacgcggaccgccgguggugcuucgacggcaucaagaacaaccagauccuggaggagaacguggaggucgagaucuggaccaaggagggggagcgcaagaagcugaagccgcgguggcucgacgcccgcaucuacagcgacccccuggcccugaaggaguucaaggaguucgccgcgggccggaagucccucacccugaaccugaucaccgagaugggccgccuccccacguucaugacccagaaggcccgggacgcccuggacaaccuggccgugcuccacaccgccgaggucgggggccgcgcguacaaccacgcccugagcgagcugcccgagacccucgagacgcugcugcuccugacccugcucgccaccgugaccgggggcaucuuccuguuccugauguccggcaaggggaucggcaagaugacgcucgggaugugcugcaucaucaccgccagcauccugcugugguacgcccagauccagccgcacuggaucgcggccuccaucauccucgaguucuuccugaucgugcugcucauccccgagcccgagaagcagcggacgccccaggacaaccagcugaccuacgucgugaucgccauccugaccguggucgccgccacgauggcgaacgagaugggcuuccucgagaagaccaagaaggaccuggggcugggcagcaucaucacccaggagagcgaguccaacauccucgacaucgaccugcgcccggccagcgccuggacccuguacgccguggccacgaccuucgugacccccaugcuccggcacuccaucgagaacagcuccgucaacgugagccugaccgcgaucgccaaccaggccacggugcugaugggccucgggcgcggcuggccccuguccaagauggacaucggggucccccugcucgccaucggcugcuacagccaggugaacccgaucacccugaccgcggcccugcuccugcugguggcccacuacgccaucaucgggcccggccuccaggccaaggcgacccgcgaggcccagaagcgggccgccgccggcaucaugaagaaccccacggucgacgggaucaccgugaucgaccuggagcccaucccguacgaccccaaguucgagaagcagcugggccaggugaugcuccugguccugugcgugacccaggugcucaugaugcgcaccacgugggcgcugugcgaggcccugacccucgccaccgggcccaucuccacccugugggagggcaaccccgggcgguucuggaacacgaccaucgccgucagcauggccaacaucuuccgcggcuccuaccuggcgggcgccgggcuccuguucagcaucaugaagaacaccaccaacacgcggcgcggcaccgggaacaucggcgagacccugggcgagaaguggaagucccggcucaacgcccugggcaagagcgaguuccagaucuacaagaaguccggcauccaggagguggaccgcacccuggccaaggaggggaucaagcggggcgagacggaccaccacgcggugagccgcggguccgccaagcuccggugguucgucgagcgcaacauggugaccccggagggcaagguggucgaccugggcugcgggcggggcggguggagcuacuacugcggcgggcugaagaacgugcgcgaggugaagggccucaccaagggcgggcccggccacgaggagcccauccccauguccaccuacggguggaaccugguccggcugcagagcggcguggacguguucuucacgccgcccgagaagugcgacacccuccugugcgacaucggggagagcucccccaaccccaccaucgaggccggccgcacccugcggguccucaaccugguggagaacuggcugaacaacaacacgcaguucugcaucaaggugcucaacccguacaugcccagcgucaucgagaagauggagacccugcagcgcaaguacggcggggcccuggugcggaacccccugucccgcaacagcacccacgagauguacuggguguccaacgccaccggcaacaucgucagcuccgugaacaugaucagccgcaugcucaucaaccgguucaccaugaagcacaagaaggcgacguacgagccggacguggaccugggguccggcacccgcaacaucgggaucgagaacgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccuccugaccaagcccugggacgucgugccgauggugacccagauggccaugacggacaccacccccuucgggcagcagcgggucuucaaggagaagguggacacccgcacgcaggagcccaaggagggcaccaagaagcugaugcggaucaccgccgaguggcucuggaaggagcugggcaagaagaagacgccccgcaugugcacgcgggaggaguucacccgcaaggugcgguccaacgcggcccugggggccaucuucaccgacgagaacaaguggaaguccgcccgcgaggccgucgaggacucccgguucugggagcucguggaccgcgagcggaaccugcaccuggagggcaagugcgagaccugcgucuacaacaugauggggaagcgcgagaagaagcucggcgaguucgggaaggcgaagggcagccgggccaucugguacauguggcugggcgcccgcuuccuggaguucgaggcccucggguuccugaacgaggaccacugguucucccggggcaacagccugagcgggguggagggcgaggggcuccacaagcugggcuacauccugcgcgacguguccaagaaggagggcggggcgauguacgccgacgacacggccggcugggacacccggaucacccucgaggaccugaagaacgaggagauggucaccaaccacaugaagggggagcacaagaagcuggccgaggccaucuucaagcucacguaccagaacaagguggugcgcguccagcgcccgacgccccggggcaccgugauggacaucaucagccgcaaggaccagcggggguccggccaggugggcaccuacgggcugaacacguucaccaacauggaggcgcagcugauccgccagauggagggcgaggggaucuucaagagcauccagcaccucaccgucaccgaggagaucgccgugcggaacuggcuggcccgcgugggccgggagcgccugucccggauggccaucagcggcgacgacugcgucgugaagccccucgacgaccgcuucgccuccgcgcugacggcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcccgcaucagccagggggccggcuggucccucaaggagaccgccugccugggcaagagcuacgcgcagauguggacccugauguacuuccaccggcgcgaccuccggcuggccgccaacgccaucugcuccgccgugcccagccacuggguccccacgucccgcaccaccuggagcauccacgcgaagcacgaguggaugaccaccgaggacaugcuggccguguggaaccgcguguggauccaggagaacccguggauggaggacaagacgcccgucgaguccugggaggaggugcccuaccucgggaagcgggaggaccaguggugcggcagccugaucgggcugaccagccgcgccaccugggccaagaacauccagaccgcgaucaaccaggugcggucccucaucggcaacgaggaguacacggacuacaugcccagcaugaagcgcuuccggaaggaggaggaggaggccgggguccugugguga

SEQ ID NO: 9404 - RNA, 9876 nt, Artificial Sequence
  derived and/or modified CDS sequence (opt1) from DENV-2__EU596487__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacgggguggucaagcugcucaccaagcccugggacguggugccgauggucacgcagauggccaugaccgacaccacccccuucggccagcagcgcguguucaaggagaagguggacacgcggacccaggagcccaaggagggcaccaagaagcugaugcgcaucaccgccgaguggcuguggaaggagcucgggaagaagaagacgccccggaugugcacccgcgaggaguucacccggaagguccgcagcaacgcggcccugggcgccaucuucaccgacgagaacaaguggaaguccgcccgggaggccguggaggacagccgcuucugggagcuggucgaccgggagcgcaaccuccaccuggaggggaagugcgagacgugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggcgcgauguacgccgacgacaccgccgggugggacacccgcaucacccuggaggaccucaagaacgaggagauggugacgaaccacaugaagggcgagcacaagaagcuggccgaggccaucuucaagcugaccuaccagaacaaggugguccgggugcagcgcccgacgccccgggggaccgugauggacaucaucucccggaaggaccagcgcggcagcggccaggucgggacguacggccucaacaccuucaccaacauggaggcgcagcugauccggcagauggagggggagggcaucuucaaguccauccagcgccugaccgugacggaggagaucgccgugcagaacuggcucgcccgggucggccgcgagcggcugagccgcauggccaucuccggggacgacugcguggugaagccccuggacgaccgguucgccagcgcgcucaccgcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagaccgccugccucgggaaguccuacgcgcagauguggacgcugauguacuuccaccgccgggaccugcgccucgccgccaacgccaucugcagcgccguccccucccacugggugcccaccagccggaccaccugguccauccacgcgaagcacgaguggaugaccacggaggacaugcuggccguguggaaccgcgucuggauccaggagaacccguggauggaggacaagacccccguggagagcugggaggaggugcccuaccugggcaagcgcgaggaccaguggugcgggagccucaucggccugaccucccgggccaccugggccaagaacauccagacggcgaucaaccagguccgcagccugaucgggaacgaggaguacaccgacuacaugcccuccaugaagcgguuccgcaaggaggaggaggaggccggcgugcucugguga

SEQ ID NO: 9405 - RNA, 9876 nt, Artificial Sequence
  derived and/or modified CDS sequence (opt1) from DENV-2__EU569713__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcuccgacaccgggaagcacggcaaggagaucaagaucaccccgcagagcuccaucaccgaggccgagcucaccggguacggcacggugaccauggagugcagcccccgcaccggccuggacuucaacgagauggugcugcuccagauggaggacaaggccuggcugguccaccggcagugguuccuggaccucccccugcccuggcugccgggggccgacacccagggcuccaacuggauccagaaggagacgcucgugaccuucaagaacccccacgcgaagaagcaggacguggucgugcuggggagccaggagggcgccaugcacaccgcccugaccggggccacggagauccagaugagcuccggcaaccuccuguucaccggccaccugaagugccgccuccggauggacaagcugcagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucauggaccucgagaagcgguacguccuggggcgccugaucaccgugaacccgaucgugaccgagaaggacucccccgucaacaucgaggcggagccgcccuucggcgacagcuacaucaucaucgggguggagccgggccagcucaagcugaacugguucaagaagggguccagcaucggccagauguucgagaccacgaugcgcggcgccaagcggauggccauccugggggacaccgccugggacuucggcucccucgggggcguguucaccagcaucgggaaggcccugcaccaggucuucggcgcgaucuacggcgccgccuucuccggggugagcuggaccaugaagauccugaucggcgugaucaucacguggaucgggaugaacucccgcagcaccucccugagcgucucccucgugcuggugggcgucgugacccuguaccucggggugaugguccaggccgacagcggcugcgugguguccuggaagaacaaggagcugaagugcggcagcgggaucuucaucaccgacaacguccacacguggaccgagcaguacaaguuccagcccgagagccccuccaagcuggcgagcgccauccagaaggcccacgaggagggcaucugcgggauccgguccgugacccgccucgagaaccugauguggaagcagaucacccccgagcugaaccacauccucagcgagaacgaggccaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccagaccuuccugaucgacgggcccgagaccgccgagugcccgaacaccaaccgggccuggaacucccucgagguggaggacuacggcuucggggucuucagcacgaacaucuggcugaagcugcgcgagaagcaggacguguucugcgacuccaagcucaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgccgggcccgugagccagcacaacuaccgcccgggcuaccacacccagaccgcggggcccuggcaccugggcaagcuggagauggacuucgacuucugcgaggggacgaccgucguggugaccgaggacugcggcaaccggggccccucccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgcgauccuccugguggccgugagcuucgucacccugaucacggggaacauguccuuccgggaccucggccgcgugauggugauggucggggccaccaugaccgacgacaucggcaugggcgugaccuaccuggcccugcucgccgcguucaaggugcgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugaugguccucaagaucgugcgcaacauggagaaguaccagcuggccgugaccaucauggccauccugugcgucccgaacgccgugauccuccagaacgcguggaagguguccugcaccauccuggccgccgucagcgugagcccccugcuccugacgagcucccagcagaaggccgacuggaucccccuggcgcucaccaucaagggccugaaccccaccgccaucuuccugaccacgcucagccggaccuccaagaagcgcagcuggccgcugaacgaggccgucauggccgugggcaugguguccauccuggccagcagccuccugaagaacgacauccccaugaccgggccccuggucgcgggcgggcuccugaccgugugcuacgugcugacgggccgguccgccgaccucgagcuggagcgcgccgccgacgucaagugggaggaccaggccgagaucagcggguccagccccauccuguccaucaccaucagcgaggacggcuccaugagcaucaagaacgaggaggaggagcagacccucaccauccugauccggacgggccugcucgugaucuccgggguguucccggucagcauccccaucaccgcggccgccugguaccugugggaggugaagaagcagcgcgccggcgugcugugggacguccccagcccgccgcccguggggaaggccgagcucgaggacggcgcguaccggaucaagcagcgcgggaucuucggcuacagccagaucggcgccgggguguacaaggagggcaccuuccacaccauguggcacgucacccgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagacgaagcccggccucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucucccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuuccgggcggagcgcgucaucgacccccggcgcugcaugaagcccgugauccugaccgacggcgaggagcgggugauccuggccgggcccaugccggucacccacagcuccgccgcccagcgccgcggccggaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagacguucguggaccugaugcggcgcggggaccugcccgucuggcucgccuaccggguggccgcggagggcaucaacuacgccgaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcccugaaggaguucaaggaguucgcggccggccgcaagagccucacccugaaccugaucaccgagauggggcgccuccccacguucaugacccagaaggcccgggacgcccuggacaaccuggccgugcuccacaccgcggaggucggcgggcgcgccuacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcgcagauccagccgcacuggaucgccgccagcaucauccucgaguucuuccugaucgugcugcucauccccgagcccgagaagcagcggacgccccaggacaaccagcugaccuacgucgugaucgccauccugaccguggucgccgcgacgauggccaacgagaugggguuccucgagaagaccaagaaggaccugggccugggcagcaucaucacccaggaguccgagagcaacauccucgacaucgaccugcgcccggccuccgccuggacccuguacgccguggcgacgaccuucgugacccccaugcuccggcacagcaucgagaacuccagcgucaacgugucccugaccgccaucgccaaccaggccacggugcugauggggcucggccgcggguggccccugagcaagauggacaucggcgucccccugcucgcgaucgggugcuacucccaggugaacccgaucacccugaccgccgcccugcuccugcugguggcccacuacgccaucaucggccccggccuccaggcgaaggccacccgcgaggcccagaagcgggccgccgcggggaucaugaagaaccccacggucgacggcaucaccgugaucgaccuggagcccaucccguacgaccccaaguucgagaagcagcugggccaggugaugcuccugguccugugcgugacccaggugcucaugaugcgcaccacgugggcccugugcgaggcccugacccucgccaccggccccaucagcacccugugggaggggaaccccggccgguucuggaacacgaccaucgccgucuccauggcgaacaucuuccgcggcagcuaccuggccggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggcgaaggagggcaucaagcgcggggagacggaccaccacgccgugucccgcggcagcgccaagcuccggugguucgucgagcgcaacauggugaccccggagggcaagguggucgaccuggggugcggccgcggcgggugguccuacuacugcggcgggcugaagaacgugcgcgaggugaaggggcucaccaagggcgggcccgggcacgaggagcccauccccaugagcaccuacggcuggaaccugguccggcugcagagcgggguggacguguucuacacgccgcccgagaagugcgacacccuccugugcgacaucggcgaguccagccccaaccccaccaucgaggccggccgcacccugcggguccucaaccugguggagaacuggcugaacaacaacacgcaguucugcaucaaggugcucaacccguacaugcccuccgucaucgagaagauggagacccugcagcgcaaguacgggggcgcccuggugcggaacccccugagccgcaacuccacccacgagauguacugggugagcaacgcgaccgggaacaucgucuccagcgugaacaugaucucccgcaugcucaucaaccgguucaccaugaagcacaagaaggccacguacgagccggacguggaccugggcagcgggacccgcaacaucggcaucgagaacgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccuccugaccaagcccugggacgucgugccgauggugacccagauggccaugacggacaccacccccuucggccagcagcgggucuucaaggagaagguggacacccgcacgcaggagcccaaggagggcaccaagaagcugaugcggaucaccgcggaguggcucuggaaggagcuggggaagaagaagacgccccggaugugcacgcgggaggaguucacccgcaaggugcggagcaacgccgcccugggcgccaucuucaccgacgagaacaaguggaaguccgcccgcgaggcggucgaggacagccgguucugggagcucguggaccgcgagcggaaccugcaccuggaggggaagugcgagaccugcgucuacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggggaacagccuguccggcguggagggggagggccuccacaagcugggcuacauccugcgcgacgugagcaagaaggagggcggggccauguacgccgacgacacggccgggugggacacccggaucacccucgaggaccugaagaacgaggagauggucaccaaccacaugaagggcgagcacaagaagcuggccgaggcgaucuucaagcucacguaccagaacaagguggugcgcguccagcgcccgacgccccgggggaccgugauggacaucaucucccgcaaggaccagcggggcagcggccagguggggaccuacggccugaacacguucaccaacauggaggcccagcugauccgccagauggagggggagggcaucuucaaguccauccagcaccucaccgucaccgaggagaucgccgugcagaacuggcuggcccgggugggccgcgagcggcugagccgcauggccaucuccggggacgacugcgucgugaagccccucgacgaccgguucgcgagcgcccugacggcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucgggcgcgcccggaucucccagggcgccggcuggagccucaaggagaccgcgugccuggggaaguccuacgcccagauguggacccugauguacuuccaccgccgggaccuccgccuggccgccaacgccaucugcagcgcggugcccucccacuggguccccacgagccggaccaccugguccauccacgccaagcacgaguggaugaccaccgaggacaugcuggccguguggaaccgcguguggauccaggagaacccguggauggaggacaagacgcccgucgagagcugggaggaggugcccuaccucggcaagcgcgaggaccaguggugcgggagccugaucggccugaccucccgggccaccugggcgaagaacauccagaccgccaucaaccaggugcgcagccucaucgggaacgaggaguacacggacuacaugcccuccaugaagcgguuccgcaaggaggaggagaaggccggcguccugugguga

SEQ ID NO: 9406 - RNA, 9876 nt, Artificial Sequence
  derived and/or modified CDS sequence (opt1) from DENV-2__EU569714__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgugauccuccuggucgccguguccuucgugacccugaucacggggaacaugagcuuccgggaccucggccgcgucauggugauggugggggcgaccaugaccgacgacaucggcaugggcgucaccuaccuggcccugcucgccgccuucaaggugcgccccacguucgccgcggggcugcugcuccggaagcugaccuccaaggagcugaugauggccaccaucggcaucgcccuccugagccaguccaccauccccgagacgauccuggagcucaccgacgcccuggcccuggggaugauggugcucaagaucguccgcaacauggagaaguaccagcuggcggugaccaucauggccaucagcugcgugccgaacgccgucauccugcagaacgccuggaagguguccugcaccauccucgccgucgugagcgugagcccccugcugcucacgagcucccagcagaaggcggacuggaucccccuggcccugaccaucaagggccucaaccccaccgccaucuuccugaccacgcugagccggaccuccaagaagcgcagcuggccgcucaacgaggccgucauggcggugggcaugguguccauccuggccagcagccugcucaagaacgacauccccaugaccgggccccuggucgccggcgggcugcucaccgugugcuacgugcugacgggccgguccgccgaccuggagcucgagcgcgccgcggacgucaagugggaggaccaggccgagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgccgccgccugguaccucugggaggugaagaagcagcgcgcgggcgugcugugggacguccccagcccgccgcccguggggaaggccgagcuggaggacggcgccuaccggaucaagcagcgcgggaucuucggcuacagccagaucggcgccgggguguacaaggagggcaccuuccacaccauguggcacgucacccgcggggccgugcucaugcaccgcggcaagcggaucgagcccuccugggcggacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgccgucucccucgacuucagccccggcacguccgggagccccaucguggaccggaagggcaagguggucgggcuguacggcaacggcguggugacccgcuccggggccuacgucagcgcgaucgcccagaccgagaaguccaucgaggacaaccccgagaucgaggacgacaucuuccggaagaagcgccugaccaucauggaccuccaccccggcgccgggaagacgaagcgguaccugcccgccaucgugcgcgaggcgaucaagcggggccugcgcacccugauccucgccccgacccgcguggucgccgccgagauggaggaggcccugcgggggcugcccauccgcuaccagacccccgcgauccgggccgagcacacgggccgcgagaucguggaccucaugugccacgccaccuucaccaugcggcugcugucccccgugcgcgucccgaacuacaaccucaucaucauggacgaggcccacuucaccgaccccgccagcaucgcggcccggggcuacaucuccacgcgcguggagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagacggucugguucgugccgagcaucaaggccggcaacgacaucgccgccugccugcgcaagaacggcaagaaggugauccagcugucccggaagaccuucgacagcgaguacgucaagacccgcgcgaacgacugggacuucguggugaccacggacaucuccgagaugggggccaacuuccgggccgagcgcgucaucgacccccggcgcugcaugaagcccgugauccucaccgacggcgaggagcgggugauccuggccgggcccaugccggucacccacagcuccgccgcgcagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgccaucgacggggaguaccgccugcggggcgaggcccgcaagacguucguggaccucaugcggcgcggggaccugcccgucuggcuggcguaccggguggccgccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcgcugaaggaguucaaggaguucgccgccggccggaagucccugacccucaaccugaucaccgagauggggcgccugcccacguucaugacccagaaggcccgggacgcgcucgacaaccuggccgugcugcacaccgccgaggucggcgggcgcgccuacaaccacgcccucuccgagcugcccgagacccuggagacgcuccugcugcucacccugcuggcggccgugaccggcggcaucuuccucuuccugaugagcgggaagggcaucgggaagaugacccugggcaugugcugcaucaucacggccuccauccuccugugguacgcccagauccagccgcacuggaucgccgcgagcaucauccuggaguucuuccucaucgugcugcugauccccgagcccgagaagcagcggacgccccaggacaaccagcucaccuacgucgugaucgccauccugaccguggucgccgccaccauggccaacgagaugggguuccuggagaagacgaagaaggaccucggccugggcagcaucaucacccaggaguccgagagcaacauccuggacaucgaccuccgcccggcguccgccuggacccuguacgccguggccaccacguucgugacccccaugcugcggcacagcaucgagaacuccagcgucaacgugucccucaccgccaucgcgaaccaggccaccgugcugauggggcugggccgcggguggccccucagcaagauggacaucggcgucccccugcuggccaucgggugcuacucccaggugaacccgaucacgcucaccgccgcgcugcugcuccugguggcccacuacgccaucaucggccccggccugcaggccaaggccacccgcgaggcgcagaagcgggccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucagcacccucugggaggggaaccccggccgguucuggaacaccacgaucgccgucuccauggccaacaucuuccgcggcagcuaccuggccggggcgggccuccucuucuccaucaugaagaacaccaccaacacccggcgcgggacgggcaacaucggcgagacccugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugacgccggagggcaagguggucgaccucgggugcggccgcggcgggugguccuacuacugcggcgggcugaagaacgugcgcgaggugaaggggcugaccaagggcgggcccgggcacgaggagcccauccccaugagcaccuacggcuggaaccucguccggcugcagagcgggguggacguguucuucaccccgcccgagaagugcgacacgcugcucugcgacaucggcgaguccagccccaaccccaccaucgaggccggccgcacccugcggguccugaaccucguggagaacuggcugaacaacaacacccaguucugcaucaaggugcugaacccguacaugcccuccgucaucgagaagauggagacgcuccagcgcaaguacgggggcgcccuggugcggaacccccugagccgcaacuccacccacgagauguacugggugagcaacgccaccgggaacaucgucuccagcgugaacaugaucucccgcaugcugaucaaccgguucaccaugaagcacaagaaggccaccuacgagccggacguggaccucggcagcgggacgcgcaacaucggcaucgagaacgagauccccaaccuggacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggucaacgggguggugcgccugcucaccaagcccugggacgucgugccgauggugacccagauggccaugaccgacacgacccccuucggccagcagcgggucuucaaggagaagguggacacccgcacccaggagcccaaggagggcacgaagaagcugaugcggaucaccgccgaguggcuguggaaggagcucgggaagaagaagacgccccggaugugcacccgggaggaguucacgcgcaagguccggagcaacgccgcgcugggcgccaucuucaccgacgagaacaaguggaaguccgcccgcgaggccguggaggacagccgguucugggagcugguggaccgcgagcggaaccuccaccuggaggggaagugcgagaccugcgucuacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacagccuguccggcguggagggggagggccugcacaagcucggcuacauccugcgcgacgugagcaagaaggagggcggggccauguacgcggacgacaccgccgggugggacacgcggaucacccuggaggaccucaagaacgaggagauggucaccaaccacaugaagggcgagcacaagaagcuggccgaggccaucuucaagcugaccuaccagaacaagguggugcgcguccagcgcccgacgccccgggggaccgugauggacaucaucucccgcaaggaccagcggggcagcggccagguggggaccuacggccucaacaccuucacgaacauggaggcccagcugauccgccagauggagggggagggcaucuucaaguccauccagcaccugaccgucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacgcaggucccguucugcagccaccacuuccacgagcuggugaugaaggacggccgcgugcucgucgugcccugccggaaccaggacgagcugaucgggcgcgcccggaucucccagggcgccggcuggagccugaaggagaccgccugccucgggaaguccuacgcccagauguggacccugauguacuuccaccgccgggaccugcgccucgcggccaacgccaucugcagcgccgugcccucccacuggguccccaccagccggacgaccugguccauccacgccaagcacgaguggaugaccaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugacgucccgggccaccugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9407 - RNA, 9876 nt, Artificial Sequence
  derived and/or modified CDS sequence (opt1) from DENV-2__EU569715__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacgggguggucaagcugcucaccaagcccugggacguggugccgauggucacgcagauggccaugaccgacaccacccccuucggccagcagcgcguguucaaggagaagguggacacgcggacccaggagcccaaggagggcaccaagaagcugaugcgcaucaccgccgaguggcuguggaaggagcucgggaagaagaagacgccccggaugugcacccgcgaggaguucacccggaagguccgcagcaacgcggcccugggcgccaucuucaccgacgagaacaaguggaaguccgcccgggaggccguggaggacagccgcuucugggagcuggucgaccgggagcgcaaccuccaccuggaggggaagugcgagacgugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggcgcgauguacgccgacgacaccgccgggugggacacccgcaucacccuggaggaccucaagaacgaggagauggugacgaaccacaugaagggcgagcacaagaagcuggccgaggccaucuucaagcugaccuaccagaacaaggugguccgggugcagcgcccgacccccgggggcaccgugauggacaucaucucccgcaaggaccagcggggcagcgggcaggucggcacguacgggcucaacaccuucaccaacauggaggcgcagcugauccgccagauggagggcgagggcaucuucaaguccauccagcggcugaccgugacggaggagaucgccgugcagaacuggcucgcccgcgucgggcgggagcgccugagccggauggccaucuccggcgacgacugcguggugaagccccuggacgaccgcuucgccagcgcgcucaccgcccugaacgacauggggaagguccggaaggacauccagcagugggagcccucccgcggcuggaacgacuggacccaggugccguucugcagccaccacuuccacgagcuggugaugaaggacgggcggguccucguggugcccugccgcaaccaggacgagcugaucggccgggcccgcaucucccagggcgccggguggagccugaaggagaccgccugccucggcaaguccuacgcgcagauguggacgcugauguacuuccaccggcgcgaccugcggcucgccgccaacgccaucugcagcgccguccccucccacugggugcccaccagccgcaccaccugguccauccacgcgaagcacgaguggaugaccacggaggacaugcuggccguguggaaccgggucuggauccaggagaacccguggauggaggacaagacccccguggagagcugggaggaggugcccuaccuggggaagcgcgaggaccaguggugcggcagccucaucgggcugaccucccgcgccaccugggccaagaacauccagacggcgaucaaccagguccggagccugaucggcaacgaggaguacaccgacuacaugcccuccaugaagcgcuuccggaaggaggaggaggaggccggcgugcucugguga

SEQ ID NO: 9408 - RNA, 9876 nt, Artificial Sequence
  derived and/or modified CDS sequence (opt1) from DENV-2__EU569716__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucaucugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacccucgugacguucaagaacccccacgcgaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgccgagacccagcacgggaccaucgugauccgcgugcaguacgagggcgacggcucccccugcaagauccccuucgagaucauggaccucgagaagcgguacguccuggggcgccugaucacggugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcccugcaccaggucuucggcgcgaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggugaugguccaggccgacuccggcugcguggugagcuggaagaacaaggagcugaagugcggcuccgggaucuucaucaccgacaacguccacaccuggacggagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugaccaucaugacgggcgacaucaaggggaucaugcaggccggcaagcggagccugcgcccgcagcccaccgagcucaaguacuccuggaagaccuggggcaaggccaagaugcugagcaccgagucccacaaccagacguuccugaucgacgggcccgagaccgcggagugcccgaacaccaaccgggccuggaacagccucgaggucgaggacuacggcuucgggguguucuccaccaacaucuggcugaagcugcgcgagaagcaggacguguucugcgacagcaagcucauguccgccgccaucaaggacaaccgggccguccacgcggacaugggcuacuggaucgagagcgcccugaacgacacguggaagauggagaaggccuccuucaucgaggucaagagcugccacuggcccaagucccacacccuguggagcaacggcgugcucgaguccgagaugaucauccccaagaacuucgccgggcccgucagccagcacaacuaccgcccgggcuaccacacccagaccgccgggcccuggcaccugggcaagcuggagauggacuucgacuucugcgaggggaccacggugguggucaccgaggacugcggcaaccggggccccagccuccgcaccaccacggcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacgcgcgugggcaccaagcacgccauccuccugguggcggucuccuucgugacccugaucaccgggaacaugagcuuccgggaccucggccgcgugauggucauggugggggccacgaugaccgacgacaucggcaugggcgugaccuaccuggcccugcucgccgccuucaagguccgccccaccuucgcggccgggcugcugcuccggaagcugacguccaaggagcugaugauggccaccaucggcaucgcccuccugagccaguccaccauccccgagaccauccuggagcucacggacgcccuggcgcuggggaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugaccuccagccagcagaaggccgacuggaucccccuggcccucacgaucaagggccugaaccccaccgcgaucuuccugaccacccucucccggacgagcaagaagcgcuccuggccgcugaacgaggccgugauggccgugggcauggucagcauccuggccuccagccuccugaagaacgacauccccaugaccgggccccugguggccggcgggcuccugaccgugugcuacguccugaccggccggagcgcggaccucgagcuggagcgcgccgccgacgugaagugggaggaccaggccgagaucuccgggagcucccccauccugagcaucacgaucuccgaggacggcagcauguccaucaagaacgaggaggaggagcagacccucaccauccugauccggaccggccugcucgugaucagcggggucuucccgguguccauccccaucacggccgcggccugguaccugugggaggugaagaagcagcgcgccggcguccugugggacgugcccagcccgccgcccguggggaaggccgagcucgaggacggcgccuaccggaucaagcagcgcgggaucuucggcuacucccagaucggcgcgggggucuacaaggagggcaccuuccacaccauguggcacgugacccgcggggccgugcugaugcaccgcggcaagcggaucgagcccagcugggccgacgucaagaaggaccugaucuccuacgggggcggcuggaagcucgagggggaguggaaggagggcgaggagguccaggugcuggcccuggagcccgggaagaacccccgcgccguccagaccaagcccggccucuucaagacgaacaccgggaccaucggcgcggugagccuggacuucucccccggcaccagcgggucccccaucguggaccggaagggcaaggucguggggcuguacggcaacggcguggucacgcgcagcggggccuacguguccgccaucgcccagaccgagaaguccaucgaggacaaccccgagaucgaggacgacaucuuccggaagaagcgccucaccaucauggaccugcaccccggcgcggggaagaccaagcgguaccugcccgccaucgugcgcgaggccaucaagcggggccugcgcacgcucauccuggccccgacccgcgucguggccgcggagauggaggaggcccugcgggggcuccccauccgcuaccagacccccgccauccgggccgagcacaccggccgcgagaucguggaccugaugugccacgccacguucaccaugcggcugcucagccccguccgcgugccgaacuacaaccugaucaucauggacgaggcgcacuucaccgaccccgccuccaucgccgcccggggcuacaucagcacccgcguggagaugggggaggccgcgggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggccggcaacgacaucgcggccugccugcgcaagaacggcaagaaggucauccagcucagccggaagacguucgacuccgaguacgugaagacccgcgccaacgacugggacuucguggucaccaccgacaucagcgagaugggggccaacuuccgggccgagcgcgugaucgacccccggcgcugcaugaagcccgugauccugacggacggcgaggagcgggucauccuggcggggcccaugccggugacccacuccagcgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagaccuucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggacgaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccaccuucaugacgcagaaggcccgggacgcccuggacaaccuggccguccuccacaccgccgaggugggcgggcgcgcguacaaccacgcccugagcgagcugcccgagacccucgagacccugcugcuccugacgcugcucgccaccgugaccggcggcaucuuccuguuccugauguccgggaagggcaucgggaagaugacccucggcaugugcugcaucaucacggccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccaccauggcgaacgagaugggguuccucgagaagacgaagaaggaccugggccugggcagcaucaucacccaggagagcgaguccaacauccucgacaucgaccugcgcccggccagcgccuggacccuguacgccguggccaccacguucgucacccccaugcuccggcacuccaucgagaacagcuccgugaacgugagccugaccgcgaucgccaaccaggccaccguccugauggggcucggccgcggguggccccuguccaagauggacaucggcgugccccugcucgccaucgggugcuacagccaggugaacccgaucacgcugaccgcggcccugcuccugcuggucgcccacuacgccaucaucggccccggccuccaggccaaggcgacccgcgaggcccagaagcgggccgccgccgggaucaugaagaaccccaccguggacggcaucacggugaucgaccuggagcccaucccguacgaccccaaguucgagaagcagcuggggcaggucaugcuccuggugcugugcgugacccagguccucaugaugcgcaccaccugggcgcugugcgaggcccugacgcucgccaccggccccaucuccacccugugggaggggaaccccggccgguucuggaacaccacgaucgccgugagcauggccaacaucuuccgcggcuccuaccuggcgggggccggccuccuguucagcaucaugaagaacaccaccaacacccggcgcgggacgggcaacaucggcgagacccugggggagaaguggaagucccggcucaacgcccugggcaagagcgaguuccagaucuacaagaaguccgggauccaggagguggaccgcacccuggccaaggagggcaucaagcgcggggagaccgaccaccacgcggucagccgcggcuccgccaagcuccggugguucguggagcgcaacauggugacgccggagggcaaggucguggaccuggggugcggccgcggcggguggagcuacuacugcggcgggcugaagaacgugcgcgaggucaaggggcucaccaagggcgggcccgggcacgaggagcccauccccauguccaccuacggcuggaaccuggugcggcugcagagcgggguggacgucuucuucaccccgcccgagaagugcgacacgcuccugugcgacaucggcgagagcucccccaaccccaccaucgaggccggccgcacccugcgggugcucaaccugguggagaacuggcugaacaacaacacccaguucugcaucaagguccucaacccguacaugcccagcgugaucgagaagauggagacgcugcagcgcaaguacgggggcgcccuggugcggaacccccugucccgcaacagcacccacgagauguacugggucuccaacgccaccgggaacaucgugagcuccgugaacaugaucagccgcaugcucaucaaccgguucaccaugaagcacaagaaggcgaccuacgagccggacgucgaccugggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagaccaagcagacgggcagcgccuccagcauggugaacggggugguccgccuccugaccaagcccugggacguggugccgauggucacccagauggccaugaccgacacgacccccuucggccagcagcggguguucaaggagaagguggacacccgcacccaggagcccaaggagggcacgaagaagcugaugcggaucaccgccgaguggcucuggaaggagcuggggaagaagaagacgccccggaugugcacccgggaggaguucacgcgcaagguccgguccaacgcggcccugggcgccaucuucaccgacgagaacaaguggaaguccgcccgcgaggccguggaggacucccgguucugggagcucgucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggggaacagccugagcggcguggagggggagggccuccacaagcugggcuacauccugcgcgacgucuccaagaaggagggcggcgcgauguacgccgacgacaccgccgggugggacacgcggaucacccucgaggaccugaagaacgaggagauggugaccaaccacaugaagggcgagcacaagaagcuggccgaggccaucuucaagcucaccuaccagaacaaggugguccgcgugcagcgcccgacgccccgggggaccgugauggacaucaucagccgcaaggaccagcggggcuccggccaggucgggaccuacggccugaacaccuucacgaacauggaggcgcagcugauccgccagauggagggggagggcaucuucaagagcauccagcaccucaccgugaccgaggagaucgccgugcagaacuggcuggcccgggucggccgcgagcggcugucccgcauggccaucagcggggacgacugcguggugaagccccucgacgaccgguucgccuccgcgcugaccgcccugaacgacaugggcaagguccgcaaggacauccagcagugggagcccagccggggguggaacgacuggacccaggugccguucugcucccaccacuuccacgagcucgugaugaaggacggccgcguccugguggugcccugccggagccaggacgagcugaucgggcgcgcccggaucucccagggcgccggcuggagccucaaggagaccgccugccuggggaaguccuacgcgcagauguggacccugauguacuuccaccgccgggaccuccgccuggccgccaacgccaucugcagcgccguccccucccacugggugcccaccagccggacgaccugguccauccacgcgaagcacgaguggaugaccaccgaggacaugcuggccguguggaaccgcgucuggauccaggagaacccguggauggaggacaagacccccguggagagcugggaggaggugcccuaccucggcaagcgcgaggaccaguggugcgggagccugaucggccugacgucccgggccaccugggccaagaacauccagaccgcgaucaaccagguccgcagccucaucgggaacgaggaguacaccgacuacaugcccuccaugaagcgguuccgcaaggaggaggaggaggccggcgugcugugguga

SEQ ID NO: 9409 - RNA, 9876 nt, Artificial Sequence
  derived and/or modified CDS sequence (opt1) from DENV-2__EU569717__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcuggucaaccgguucacgaugaagcacaagaaggcgaccuacgagccggacguggaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcucaccaagcccugggacguggucccgauggugacgcagauggccaugaccgacaccacccccuucggccagcagcggguguucaaggagaaggucgacacgcgcacccaggagcccaaggagggcaccaagaagcugaugcggaucaccgccgaguggcuguggaaggagcucgggaagaagaagacgccccgcaugugcacccgggaggaguucacccgcaaggugcggagcaacgcggcccugggcgccaucuucaccgacgagaacaaguggaaguccgcccgcgaggccgucgaggacagccgguucugggagcugguggaccgcgagcggaaccuccaccuggaggggaagugcgagacgugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcgucgagggggagggccugcacaagcucggcuacauccugcgcgacgugagcaagaaggagggcggcgcgauguacgccgacgacaccgccgggugggacacccggaucacccuggaggaccucaagaacgaggagauggugacgaaccacaugaagggcgagcacaagaagcuggccgaggccaucuucaagcugaccuaccagaacaaggucgugcgcgugcagcgcccgacgccccgggggaccgucauggacaucaucucccgcaaggaccagcggggcagcggccagguggggacguacggccucaacaccuucaccaacauggaggcgcagcugauccgccagauggagggggagggcaucuucaaguccauccagcggcugaccgugacggaggagaucgccguccagaacuggcucgcccgcgugggccgggagcgccugagccggauggccaucuccggggacgacugcguggucaagccccuggacgaccgcuucgccagcgcgcucaccgcccugaacgacaugggcaaggugcggaaggacauccagcagugggagcccucccgcggguggaacgacuggacccaggugccguucugcagccaccacuuccacgagcuggucaugaaggacggccgggugcucgugguccccugccgcaaccaggacgagcugaucgggcgggcccgcaucucccagggcgccggcuggagccugaaggagaccgccugccucgggaaguccuacgcgcagauguggacgcugauguacuuccaccggcgcgaccugcggcucgccgccaacgccaucugcagcgccgugcccucccacugggugcccaccagccgcaccaccugguccauccacgcgaagcacgaguggaugaccacggaggacaugcuggccgucuggaaccgcguguggauccaggagaacccguggauggaggacaagacccccguggagagcugggaggagguccccuaccugggcaagcgggaggaccaguggugcgggagccucaucggccugaccucccgcgccaccugggccaagaacauccagacggcgaucaaccaggugcggagccugaucgggaacgaggaguacaccgacuacaugcccuccaugaagcgcuuccggaaggaggaggaggaggccggcgugcucugguga

SEQ ID NO: 9410 - RNA, 9876 nt, Artificial Sequence
  derived and/or modified CDS sequence (opt1) from DENV-2__EU569718__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggaguacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacguggaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcuccgggaucuucaucaccgacaacgugcacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgagguggaggacuacggcuucgggguguucuccacgaacaucuggcugaagcugcgcgagaagcaggacgucuucugcgacagcaagcucauguccgccgccaucaaggacaaccgggccgugcacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgucacggccgggcacggccagaucgacaacuucagccugggcgugcuggggauggcccucuuccuggaggagaugcugcggacccgcgugggcaccaagcacgccauccuccuggucgcgguguccuucgugacccugaucacggggaacaugagcuuccgggaccucggccgcgucauggugauggugggggccaccaugaccgacgacaucggcaugggcgucaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucguccgcaacauggagaaguaccagcuggccgugaccaucauggccaucagcugcgugccgaacgccgucauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgucggcaugguguccauccuggccagcagccugcucaagaacgacauccccaugaccgggccccugguggccggcgggcugcucaccgucugcuacgugcugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggucaucuccgggguguucccggugagcauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacagccagaucggcgcggggguguacaaggagggcaccuuccacaccauguggcacgugacccgcggggccguccucaugcaccgcggcaagcggaucgagcccuccugggccgacgugaagaaggaccugaucagcuacgggggcggcuggaagcuggagggggaguggaaggagggcgaggaggugcagguccucgcccuggagcccgggaagaacccccgcgccgugcagacgaagcccggccuguucaagaccaacaccgggaccaucggcgcggugucccucgacuucagccccggcacguccgggagccccaucgucgaccggaagggcaaggugguggggcuguacggcaacggcgucgugacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucguccgcgaggccaucaagcggggccugcgcacccugauccucgccccgacccgcgugguggccgcggagauggaggaggcccugcgggggcugcccauccgcuaccagacccccgccauccgggccgagcacacgggccgcgagaucgucgaccucaugugccacgccaccuucaccaugcggcugcugucccccgugcgcgugccgaacuacaaccucaucaucauggacgaggcgcacuucaccgaccccgccagcaucgccgcccggggcuacaucuccacgcgcgucgagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggugugguucgucccgagcaucaaggccggcaacgacaucgcggccugccugcgcaagaacggcaagaaggugauccagcugucccggaagaccuucgacagcgaguacgugaagacccgcgccaacgacugggacuucgucgugaccacggacaucuccgagaugggggccaacuuccgggccgagcgcgugaucgacccccggcgcugcaugaagcccgucauccucaccgacggcgaggagcgggugauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaaggucgacgcgaucgacggggaguaccgccugcggggcgaggcccgcaagacguucguggaccucaugcggcgcggggaccugcccguguggcuggccuaccgggucgccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggugggcgggaaggcguacaaccacgcccucuccgagcugcccgagacccuggagacgcuccugcugcucacccugcuggccaccgucaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacguggucaucgccauccugaccgugguggccgccacgauggcgaacgagaugggguuccuggagaagaccaagaaggaccucggccugggcagcaucaccacccaggaguccgagagcaacauccuggacaucgaccuccggccggccuccgccuggacgcuguacgccgucgccaccaccuucgugacccccaugcugcgccacagcaucgagaacuccagcgugaacgucucccucacggcgaucgccaaccaggccaccgugcugauggggcugggccggggguggccccucagcaagauggacaucggcgugccccugcuggccaucgggugcuacucccaggucaacccgaucacccucaccgcggcccugcugcuccugguggcccacuacgccaucaucggccccggccugcaggccaaggcgacgcgcgaggcccagaagcgcgccgccgccgggaucaugaagaaccccaccguggacggcaucaccgucaucgaccucgagcccaucccguacgaccccaaguucgagaagcagcugggccaggugaugcugcucgugcugugcgucacccaggugcugaugaugcggacgaccugggcgcucugcgaggcccugacccuggccaccggccccaucagcacgcucugggaggggaaccccggccgcuucuggaacaccaccaucgccguguccauggccaacaucuuccggggcagcuaccuggcgggggccggccuccucuucuccaucaugaagaacaccacgaacacccgccgggggaccggcaacaucggcgagacccugggggagaaguggaagucccgccugaacgcccucggcaaguccgaguuccagaucuacaagaaguccgggauccaggaggucgaccggacgcuggccaaggagggcaucaagcgcggggagaccgaccaccacgcggugucccggggcagcgccaagcugcgcugguucguggagcggaacauggucaccccggagggcaaggugguggaccucgggugcggccgcgggggcugguccuacuacugcgggggccugaagaacguccgggaggugaagggccugaccaagggcgggcccgggcacgaggagcccauccccaugagcacguacggcuggaaccucgugcgccugcagagcggggucgacguguucuucaccccgcccgagaagugcgacacccugcucugcgacaucggcgaguccagccccaaccccaccaucgaggccggccggacgcugcgcgugcugaaccucgucgagaacuggcugaacaacaacacccaguucugcaucaaggugcugaacccguacaugcccuccgugaucgagaagauggagacccuccagcggaaguacgggggcgcccugguccgcaacccccugagccggaacuccacccacgagauguacugggugagcaacgccaccgggaacaucguguccagcgucaacaugaucucccgcaugcugaucaaccgcuucacgaugaagcacaagaaggcgaccuacgagccggacguggaccucggcagcgggacccggaacaucggcaucgagaacgagauccccaaccuggacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcggcugcucaccaagcccugggacguggucccgauggugacgcagauggccaugaccgacaccacccccuucggccagcagcgcguguucaaggagaaggucgacacgcggacccaggagcccaaggagggcaccaagaagcugaugcgcaucaccgccgaguggcuguggaaggagcucgggaagaagaagacgccccggaugugcacccgcgaggaguucacccggaaggugcgcagcaacgcggcccugggcgccaucuucaccgacgagaacaaguggaaguccgcccgggaggccgucgaggacagccgcuucugggagcugguggaccgggagcgcaaccuccaccuggaggggaagugcgagacgugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacagccuguccggcgucgagggggagggccugcacaagcucggcuacauccugcgggacgugagcaagaaggagggcggggcgauguacgccgacgacaccgccgggugggacacccgcaucacccuggaggaccucaagaacgaggagauggugacgaaccacaugaagggcgagcacaagaagcuggccgaggccaucuucaagcugaccuaccagaacaaggucgugcgggugcagcgcccgacgccccgcgggaccgucauggacaucaucucccggaaggaccagcgcggcagcggccagguggggacguacggccucaacaccuucaccaacauggaggcgcagcugauccggcagauggagggggagggcaucuucaaguccauccagcgccugaccgugacggaggagaucgccguccagaacuggcucgcccgggugggccgcgagcggcugagccgcauggccaucuccggggacgacugcguggucaagccccuggacgaccgguucgccagcgcgcucaccgcccugaacgacaugggcaaggugcgcaaggacauccagcagugggagcccucccggggguggaacgacuggacccaggugccguucugcagccaccacuuccacgagcuggucaugaaggacggccgcgugcucgugguccccugccggaaccaggacgagcugaucgggcgcgcccggaucucccagggcgccggcuggagccugaaggagaccgccugccucgggaaguccuacgcgcagauguggacgcugauguacuuccaccgccgggaccugcgccucgccgccaacgccaucugcagcgccgugcccucccacugggugcccaccagccggaccaccugguccauccacgcgaagcacgaguggaugaccacggaggacaugcuggccgucuggaaccgcguguggauccaggagaacccguggauggaggacaagacccccguggagagcugggaggagguccccuaccugggcaagcgcgaggaccaguggugcgggagccucaucggccugaccucccgggccaccugggccaagaacauccagacggcgaucaaccaggugcgcagccugaucgggaacgaggaguacaccgacuacaugcccuccaugaagcgguuccgcaaggaggaggaggaggccggcgugcucugguga

SEQ ID NO: 9411 - RNA, 9876 nt, Artificial Sequence
  derived and/or modified CDS sequence (opt1) from DENV-2__EU596488__SS-prME
accgccggcgugaucaucaugcugauccccaccgucauggccuuccaccucaccacccgcaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgccauccuggcguacaccaucgggaccacccacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacaccaucgucaucacgccccacagcggggaggagcacgcggugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgccaagaagcaggacgucgugguccuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccacgaugcgcggcgcgaagcggauggccauccugggggacaccgccugggacuucggcagccucgggggcgucuucaccuccaucgggaaggcccugcaccagguguucggcgccaucuacggcgcggccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacaccggcugcguggucuccuggaagaacaaggagcugaagugcggcagcgggaucuucaucacggacaacgugcacaccuggaccgagcaguacaaguuccagcccgagucccccagcaagcuggccagcgcgauccagaaggcccacgaggagggcaucugcgggauccgguccgugacccgccucgagaaccugauguggaagcagaucacgcccgagcugaaccacauccucagcgagaacgaggucaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgccgagugcccgaacacgaaccgggcguggaacucccucgagguggaggacuacggcuucgggguguucagcaccaacaucuggcugaagcugcgcgagaagcaggacgucuucugcgacuccaagcucaugagcgccgccaucaaggacaaccgggccgugcacgccgacaugggcuacuggaucgaguccgcgcugaacgacaccuggaagauggagaaggccagcuucaucgagaucaaguccugccacuggcccaagagccacacccugugguccaacggcgugcucgagagcgagaugaucauccccaagaacuucgccgggcccgucucccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgcggggcacggccagaucgacaacuucucccugggcguccuggggauggcccucuuccuggaggagaugcugcggacccgcgugggcaccaagcacgccauccuccugguggccgucagcuucgugacgcugaucaccgggaacauguccuuccgggaccucggccgcgugauggucauggugggggcgaccaugaccgacgacaucggcaugggcgugacguaccuggcccugcucgccgccuucaagguccgccccaccuucgccgcggggcugcugcuccggaagcugaccagcaaggagcugaugauggccaccaucggcaucgcccuccugucccagagcacgauccccgagaccauccuggagcucaccgacgcccuggcccuggggaugauggugcucaagaucgugcgcaacauggagaaguaccagcuggcggucaccaucauggccaucuccugcgugccgaacgccgugauccugcagaacgccuggaaggucagcugcacgauccucgccgcgguguccgucagcccccugcugcucaccuccagccagcagaaggccgacuggaucccccuggcccugaccaucaagggccucaaccccaccgccaucuuccugacgacccugucccggaccagcaagaagcgcuccuggccgcucaacgaggcggugauggccgugggcauggucagcauccuggccuccagccugcucaagaacgacauccccaugaccgggccccugguggccggcgggcugcucacggugugcuacguccugaccggccggagcgccgaccuggagcucgagcgcgcggccgacgugaagugggaggaccaggccgagaucuccgggagcucccccauccugagcaucaccaucuccgaggacggcagcauguccaucaagaacgaggaggaggagcacacccugacgauccucauccggaccggccugcuggugaucagcggggucuucccgguguccauccccaucaccgccgccgcgugguaccucugggaggugaagaagcagcgcgccggcguccugugggacgugcccagcccgccgcccguggggaaggccgagcuggaggacggcgccuaccggaucaagcagcgcgggaucuucggcuacucccagaucggcgccggggucuacaaggagggcaccuuccacaccauguggcacgugacgcgcggggcggugcucaugcaccgcggcaagcggaucgagcccagcugggccgacgucaagaaggaccugaucuccuacgggggcggcuggaagcuggagggggaguggaaggagggcgaggagguccaggugcucgcccuggagcccgggaagaacccccgcgccguccagaccaagcccggccuguucaagaccaacaccgggacgaucggcgccgugagccucgacuucucccccggcaccagcgggucccccaucguggaccggaagggcaaggucguggggcuguacggcaacggcguggucacccgcagcggggcguacguguccgccaucgcccagaccgagaaguccaucgaggacaaccccgagaucgaggacgacaucuuccggaagaagcgccugacgaucauggaccuccaccccggcgccgggaagaccaagcgguaccugcccgcgaucgugcgcgaggccaucaagcggggccugcgcacccugauccucgccccgacccgcgucguggccgccgagauggaggaggcgcugcgggggcugcccauccgcuaccagacgcccgccauccgggccgagcacaccggccgcgagaucguggaccucaugugccacgccaccuucaccaugcggcugcugagccccguccgcgugccgaacuacaaccucaucaucauggacgaggcccacuucacggaccccgcguccaucgccgcccggggcuacaucagcacccgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggccggcaacgacaucgccgcgugccugcgcaagaacggcaagaaggucauccagcugagccggaagaccuucgacuccgaguacgugaagacccgcgccaacgacugggacuucguggucacgaccgacaucagcgagaugggggccaacuuccgggccgagcgcgugaucgacccccggcgcugcaugaagcccgugauccucaccgacggcgaggagcgggucauccuggccgggcccaugccggugacccacuccagcgcggcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgccaucgacggggaguaccgccugcggggcgaggcgcgcaagaccuucgucgaccucaugcggcgcggggaccugcccguguggcuggccuaccggguggccgccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcgcgcaucuacagcgacccccucgcccugaaggaguucaaggaguucgccgccggccggaagucccugacccucaaccugaucacggagauggggcgccugcccaccuucaugacccagaaggcgcgggacgcccucgacaaccuggccguccugcacaccgccgaggugggcgggcgcgccuacaaccacgcgcucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgccgcguccaucauccuggaguucuuccucaucguccugcugauccccgagcccgagaagcagcggacgccccaggacaaccagcucaccuacguggugaucgccauccugacggucguggccgccaccauggccaacgagaugggguuccuggagaagaccaagaaggaccucggccugggcagcaucaccacgcaggagagcgaguccaacauccuggacaucgaccuccgcccggcgagcgccuggacccuguacgccguggccaccaccuucgucacgcccaugcugcggcacuccaucgagaacagcuccgugaacgugagccucaccgccaucgcgaaccaggccaccguccugauggggcugggccgcggguggccccucuccaagauggacaucggcgugccccugcuggccaucgggugcuacagccaggugaacccgaucacccucacggccgcgcugcugcuccuggucgcccacuacgccaucaucggccccggccugcaggccaaggccacccgcgaggcgcagaagcggaccgccgccgggaucaugaagaaccccaccguggacggcaucacggugaucgaccucgagcccaucccguacgaccccaaguucgagaagcagcuggggcaggucaugcugcucgugcugugcgugacccagguccugaugaugcgcaccaccugggcccucugcgaggcccugacgcuggcgaccggccccaucuccacccucugggaggggaaccccggccgguucuggaacaccacgaucgccgugagcauggccaacaucuuccgcggcuccuaccuggccggggccggccuccucuucagcaucaugaagaacaccaucaacacccggcgcgggaccggcaacaucggcgagacgcugggggagaaguggaagucccggcugaacgcgcucggcaagagcgaguuccagaucuacaagaaguccgggauccaggagguggaccgcacccuggccaaggagggcaucaagcgcggggagaccgaccaccacgccgucagccgcggcuccgccaagcugcggugguucguggagcgcaacauggugaccccggagggcaaggucguggaccucgggugcggccgcggcggguggagcuacuacugcggcgggcugaagaacgugcgcgaggucaaggggcugacgaagggcgggcccgggcacgaggagcccauccccauguccaccuacggcuggaaccucgugcggcugcagagcgggguggacgucuucuucaccccgcccgagaagugcgacacccugcucugcgacaucggcgagagcucccccaaccccacgaucgaggcgggccgcacccugcgggugcugaaccucguggagaacuggcugaacaacaacacccaguucugcgucaaggugcugaacccguacaugcccagcgugaucgagaagauggagacccuccagcgcaaguacgggggcgcccugguccggaacccccugucccgcaacagcacccacgagauguacuggguguccaacgccacggggaacaucgugagcuccgucaacaugaucagccgcaugcugaucaaccgguucaccaugaagcacaagaaggccaccuacgagccggacguggaccucggcuccgggacccgcaacaucggcaucgagaacgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgcguccagcauggugaacggggucgugaagcugcucacgaagcccugggacguggucccgauggugacccagauggccaugaccgacaccacgcccuucggccagcagcgcguguucaaggagaaggucgacacccggacccaggagcccaaggagggcaccaagaagcugaugcgcaucacggccgaguggcuguggaaggagcucgggaagaagaagacgccccggaugugcacccgcgaggaguucacccggaaggugcgcuccaacgccgcccugggcgcgaucuucacggacgagaacaaguggaaguccgcccgggaggccgucgaggacucccgcuucugggagcugguggaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcgucgagggggagggccugcacaagcucggcuacauccugcgggacguguccaagaaggagggcggggccauguacgccgacgacaccgcggggugggacacccgcaucacgcuggaggaccucaagaacgaggagauggugaccaaccacaugaagggcgagcacaagaagcuggccgaggccaucuucaagcugaccuaccagaacaaggucgugcgggugcagcgcccgacgccccgggggacggucauggacaucaucagccggaaggaccagcgcggcuccggccagguggggaccuacggccucaacaccuucaccaacauggaggcccagcugauccggcagauggagggggagggcaucuucaagagcauccagcgccugacggugaccgaggagaucgccguccagaacuggcucgcgcgggugggccgcgagcggcugucccgcauggccaucagcggggacgacugcguggucaagccccuggacgaccgguucgccuccgcccucaccgcccugaacgacaugggcaaggugcgcaaggacauccagcagugggagcccagccggggguggaacgacuggacccaggugccguucugcucccaccacuuccacgagcuggucaugaaggacggccgcgugcucgugguccccugccggaaccaggacgagcugaucgggcgcgcgcggaucagccagggcgccggcuggucccugaaggagacggccugccucggcaagagcuacgcccagauguggacccugauguacuuccaccgccgggaccugcgccucgccgcgaacgccaucugcuccgccgugcccagccacugggugcccaccucccggaccaccuggagcauccacgccaagcacgaguggaugacgaccgaggacaugcuggccgucuggaaccgcguguggauccaggagaacccguggauggaggacaagacccccguggaguccugggaggagguccccuaccugggcaagcgcgaggaccaguggugcgggagccucaucggccugaccagccgggcgacgugggccaagaacauccagaccgccaucaaccaggugcgcucccugaucgggaacgaggaguacaccgacuacaugcccagcaugaagcgguuccgcaaggaggaggaggaggccggcgugcucugguga

SEQ ID NO: 9412 - RNA, 9876 nt, Artificial Sequence
  derived and/or modified CDS sequence (opt1) from DENV-2__EU596489__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaccauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacacgaucgugaucacgccccacagcggggaggagcacgccgucggcaacgacaccgggaagcacggcaaggagaucaagaucaccccgcaguccagcaucaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagacgaccaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggacgaugaagauccugaucggcgugaucaucaccuggaucgggaugaacagccgcuccaccagccuguccgucagccucgugcuggugggcaucgucacccuguaccucggggugauggugcaggccgacacgggcugcgucguguccuggaagaacaaggagcugaagugcggcagcgggaucuucaucaccgacaacgugcacaccuggaccgagcaguacaaguuccagcccgaguuccccuccaagcuggcgagcgccaucaagaaggcccacgaggagggcaucugcgggauccggagcgucacgcgccucgagaaccugauguggaagcagaucacccccgagcugaaccacauccucuccgagaacgaggugaagcugaccaucaugaccggcgacaucaaggggaucaugcaggccggcaagcggagccugcgcccgcagcccacggagcucaaguacuccuggaagaccuggggcaaggccaagaugcugagcaccgagucccacaaccagaccuuccugaucgacgggcccgagacggcggagugcccgaacaccaaccgggccuggaacagccucgagguggaggacuacggcuucggggucuucuccaccaacaucuggcugaagcugcgcgagaagcaggacguguucugcgacagcaagcucauguccgccgccaucaaggacaaccgggccgugcacgcggacaugggcuacuggaucgagagcgcccugaacgacaccuggaagauggagaaggccuccuucaucgagaucaagagcugccacuggcccaagucccacacccuguggagcaacggcguccucgaguccgagaugaucauccccaagaacuucgccgggcccgugagccagcacaacuaccgcccgggcuaccacacgcagaccgccgggcccuggcaccugggcaagcuggagauggacuucgacuucugcgaggggaccaccguggucgugacggaggacugcggcaaccggggccccucccuccgcaccaccaccgcgagcgggaagcugaucacggaguggugcugccggagcugcacccugcccccgcuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcgugggcacgaagcacgccauccuccuggucgcgguguccuucgugacccugaucaccgggaacaugagcuuccgggaccucggccgcgucauggugauggugggggccaccaugacggacgacaucggcaugggcgucaccuaccuggcccugcucgccgccuucaaggugcgccccaccuucgcggccgggcugcugcuccggaagcugaccuccaaggagcugaugauggccacgaucggcaucgcccuccugagccaguccaccauccccgagaccauccuggagcucaccgacgcccuggcgcuggggaugauggugcucaagaucguccgcaacauggagaaguaccagcuggccgugacgaucauggccaucagcugcgugccgaacgccgucauccugcagaacgccuggaagguguccugcaccauccucgcggccgugagcgucagcccccugcugcucaccagcucccagcagaaggccgacuggaucccccuggcccugaccaucaagggccucaaccccacggcgaucuuccugaccacccugagccggaccuccaagaagcgcagcuggccgcucaacgaggccgugauggccgucggcaugguguccauccuggccagcucccugcucaagaacgacauccccaugacggggccccugguggccggcgggcugcucaccgucugcuacgugcugaccggccggagcgcggaccuggagcucgagaaggccgccgacgugaagugggaggaccaggccgagaucagcggguccagccccauccuguccaucaccaucagcgaggacggcuccaugagcaucaagaacgaggaggaggagcacacgcugaccauccucauccgcaccggccugcuggucaucuccgggguguucccggugagcauccccaucaccgccgcggccugguaccucugggaggucaagaagcagcgggccggcgugcugugggacgugcccagcccgccgcccgucgggaaggccgagcuggaggacggcgccuaccgcaucaagcagcgggggaucuucggcuacagccagaucggcgcggggguguacaaggagggcaccuuccacacgauguggcacgugacccgcggggccguccucaugcaccggggcaagcgcaucgagcccuccugggccgacgugaagaaggaccugaucagcuacgggggcggcuggaagcuggagggggaguggaaggagggcgaggaggugcagguccucgcccuggagcccgggaagaacccccgggccgugcagaccaagcccggccuguucaagaccaacacggggaccaucggcgcggugucccucgacuucagccccggcaccuccgggagccccaucgucgaccgcaagggcaaggugguggggcuguacggcaacggcgucgugacccgguccggggccuacgugagcgccaucgcccagacggagaaguccaucgaggacaaccccgagaucgaggacgacaucuuccgcaagaagcggcugaccaucauggaccuccaccccggcgcggggaagaccaagcgcuaccugcccgccaucguccgggaggccaucaagcgcggccugcggacccugauccucgccccgacgcgcgugguggccgcggagauggaggaggcccugcgcgggcugcccauccgguaccagacccccgccauccgcgccgagcacaccggccgggagaucgucgaccucaugugccacgccaccuucacgaugcgccugcugagccccgugcgggugccgaacuacaaccucaucaucauggacgaggcgcacuucaccgaccccgccagcaucgccgcccgcggcuacaucuccacccgggucgagaugggggaggccgcgggcaucuucaugaccgccacgccgcccgggagccgcgacccguucccccaguccaacgcccccaucauggacgaggagcgggagauccccgagcgcagcuggaacuccggccacgagugggugaccgacuucaaggggaagaccgugugguucgucccgagcaucaaggccggcaacgacaucgcggccugccugcggaagaacggcaagaaggugauccagcugucccgcaagaccuucgacagcgaguacgugaagacgcgggccaacgacugggacuucgucgugaccaccgacaucuccgagaugggggccaacuuccgcgccgagcgggugaucgacccccgccggugcaugaagcccgucauccucaccgacggcgaggagcgcgugauccuggcggggcccaugccggugacgcacagcuccgccgcccagcggcgcggccgcaucgggcggaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgcgagaaggucgacgcgaucgacggggaguaccggcugcgcggcgaggcccggaagaccuucguggaccucaugcgccgcggggaccugcccguguggcuggccuaccgcgucgccgccgagggcaucaacuacgcggaccggcgcuggugcuucgacgggaucaagaacaaccagauccucgaggagaacguggagguggagaucuggaccaaggagggcgagcggaagaagcugaagccgcgcuggcuggacgcccggaucuacuccgacccccucgcccugaaggaguucaaggaguucgccgcgggccgcaagagccugacgcucaaccugaucaccgagauggggcggcugcccaccuucaugacccagaaggcccgcgacgcccucgacaaccuggccguccugcacacggccgaggugggcgggcgggcguacaaccacgcccucuccgagcugcccgagacccuggagacccuccugcugcucacccugcuggccacggucaccggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucacguacguggucaucgccauccugaccgugguggccgccaccauggcgaacgagaugggguuccuggagaagaccaagaaggaccucggccugggcuccaucacgacccaggagagcgagagcaacauccuggacaucgaccuccggccggccuccgccuggacccuguacgccgucgccaccacguucgugacccccaugcugcgccacagcaucgagaacuccagcgugaacgucucccucaccgcgaucgccaaccaggccaccgugcugauggggcugggccggggguggccccucagcaagauggacaucggcgugccccugcuggccaucgggugcuacucccaggucaacccgaucacgcucaccgcggcccugcugcuccugguggcccacuacgccaucaucggccccggccugcaggccaaggcgacccgcgaggcccagaagcgcaccgccgccgggaucaugaagaaccccacgguggacggcaucaccgucaucgaccucgagcccaucccguacgaccccaaguucgagaagcagcugggccaggugaugcugcucgugcugugcgucacccaggugcugaugaugcggaccacgugggcccucugcgaggcgcugacccuggccaccggccccaucagcacccucugggaggggaaccccggccgcuucuggaacacgaccaucgccguguccauggccaacaucuuccggggcagcuaccuggccggggcgggccuccucuucuccaucaugaagaacaccaccaacacgcgccgggggaccggcaacaucggcgagacccugggggagaaguggaagucccgccugaacgcccucggcaaguccgaguuccagaucuacaagaaguccgggauccaggaggucgaccggacccuggccaaggagggcaucaagcgcggggagacggaccaccacgccgugucccggggcagcgcgaagcugcgcugguucguggagcggaacauggucaccccggagggcaaggugguggaccucgggugcggccgcgggggcugguccuacuacugcgggggccugaagaacguccgggaggugaagggccugaccaagggcgggcccgggcacgaggagcccauccccaugagcaccuacggcuggaaccucgugcgccugcaguccggggucgacguguucuucacgccgcccgagaagugcgacacccugcucugcgacaucggcgagagcagccccaaccccaccaucgaggccggccggacccugcgcgugcugaaccucgucgagaacuggcugaacaacaacacccaguucugcgugaaggugcugaacccguacaugcccuccgucaucgagaagauggagacgcuccagcggaaguacgggggcgcccuggugcgcaacccccugagccggaacuccacccacgagauguacugggugagcaacgccaccgggaacaucgucuccagcgugaacaugaucucccgcaugcugaucaaccgcuucaccaugaagcacaagaaggccacguacgagccggacguggaccucggcagcgggacccggaacaucggcaucgagaacgagauccccaaccuggacaucaucggcaagcgcaucgagaagaucaagcaggagcacgagaccuccuggcacuacgaccaggaccaccccuacaagaccugggcguaccacgggagcuacgagacgaagcagaccggcuccgccagcuccauggucaacgggguggugaagcugcucaccaagcccugggacgucgugccgauggugacccagauggccaugacggacaccacccccuucggccagcagcgggucuucaaggagaagguggacacccgcacgcaggagcccaaggagggcaccaagaagcugaugcggaucaccgccgaguggcuguggaaggagcucgggaagaagaagacgccccgcaugugcacgcgggaggaguucacccgcaaggugcggagcaacgccgcgcugggcgccaucuucaccgacgagaacaaguggaaguccgcccgcgaggccgucgaggacagccgguucugggagcugguggaccgcgagcggaaccuccaccuggaggggaagugcgagaccugcgucuacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacucccugagcggcguggagggggagggccugcacaagcucggcuacauccugcgcgacgugagcaagaaggagggcggggccauguacgcggacgacacggccgggugggacacccggaucacccuggaggaccucaagaacgaggagauggucaccaaccacaugaagggcgagcacaagaagcuggccgaggccaucuucaagcugacguaccagaacaagguggugcgcguccagcggccgacgccccgcgggaccgugauggacaucaucucccgcaaggaccagcggggcagcggccagguggggaccuacggccucaacacguucaccaacauggaggcccagcugauccgccagauggagggggagggcaucuucaaguccauccagcggcugaccgucaccgaggagaucgcggugcagaacuggcucgcccgcgugggccgggagcgccugagccggauggccaucuccggggacgacugcgucgugaagccccuggacgaccgcuucgccagcgcccucacggcgcugaacgacaugggcaaggugcggaaggacauccagcagugggagcccucccgcggguggaacgacuggacccaggucccguucugcagccaccacuuccacgagcuggugaugaaggacggccggaugcucgugguccccugccgcaaccaggacgagcugaucgggcgggcccgcaucucccagggcgccggcuggagccugaaggagaccgccugccucgggaaguccuacgcccagauguggacccugauguacuuccaccggcgcgaccugcggcucgcggccaacgccaucugcagcgccgugcccucccacugggugcccaccagccgcacgaccugguccauccacgccaagcacgaguggaugaccaccgaggacaugcuggcggucuggaaccggguguggauccaggagaacccguggauggaggacaagacgcccguggagagcugggaggagguccccuaccugggcaagcgcgaggaccaguggugcgggucccucaucggccugaccagccgcgccaccugggccaagaacauccagaccgccaucaaccaggugcggagccugaucgggaacgaggaguacacggacuacaugcccuccaugaagcgcuuccggaaggaggaggaggaggcgggcgugcucugguga

SEQ ID NO: 9413 - RNA, 9876 nt, Artificial Sequence
  derived and/or modified CDS sequence (opt1) from DENV-2__EU596490__SS-prME
accgccggggugaucaucaugcugauccccaccgucauggccuuccaccucaccacccggaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcagcgagggggccuggaagcacgugcagcggaucgagaccuggauccugcgccacccgggcuucaccaucauggccgccauccuggcguacaccaucgggaccacgcacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacaccaucgucaucacgccccacagcggggaggagcacgcggugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgccaagaagcaggacgucgugguccuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccacgaugcgcggcgcgaagcggauggccauccugggggacaccgccugggacuucggcagccucgggggcgucuucaccuccaucgggaaggcccugcaccagguguucggcgccaucuacggcgcggccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacaccggcugcguggucuccuggaagaacaaggagcugaagugcggcagcgggaucuucaucacggacaacgugcacaccuggaccgagcaguacaaguuccagcccgagucccccagcaagcuggccagcgcgauccagaaggcccacgaggagggcaucugcgggauccgguccgugacccgccucgagaaccugauguggaagcagaucacgcccgagcugaaccacauccucagcgagaacgaggucaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgccgagugcccgaacacgaaccgggcguggaacucccucgagguggaggacuacggcuucgggguguucagcaccaacaucuggcugaagcugcgcgagaagcaggacgucuucugcgacuccaagcucaugagcgccgccaucaaggacaaccgggccgugcacgccgacaugggcuacuggaucgaguccgcgcugaacgacaccuggaagauggagaaggccagcuucaucgagaucaaguccugccacuggcccaagagccacacccugugguccaacggcgugcucgagagcgagaugaucauccccaagaacuucgccgggcccgucucccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgcggggcacggccagaucgacaacuucucccugggcguccuggggauggcccucuuccuggaggagaugcugcggacccgcgugggcaccaagcacgccauccuccugguggccgucagcuucgugacgcugaucaccgggaacauguccuuccgggaccucggccgcgugauggucauggugggggcgaccaugaccgacgacaucggcaugggcgugacguaccuggcccugcucgccgccuucaagguccgccccaccuucgccgcggggcugcugcuccggaagcugaccagcaaggagcugaugauggccaccaucggcaucgcccuccugucccagagcacgauccccgagaccauccuggagcucaccgacgcccuggcccuggggaugauggugcucaagaucgugcgcaacauggagaaguaccagcuggcggucaccaucauggccaucuccugcgugccgaacgccgugauccugcagaacgccuggaaggucagcugcacgauccucgccgcgguguccgucagcccccugcugcucaccuccagccagcagaaggccgacuggaucccccuggcccugaccaucaagggccucaaccccaccgccaucuuccugacgacccugucccggaccagcaagaagcgcuccuggccgcucaacgaggcggugauggccgugggcauggucagcauccuggccuccagccugcucaagaacgacauccccaugaccgggccccugguggccggcgggcugcucacggugugcuacguccugaccggccggagcgccgaccuggagcucgagcgcgcggccgacgugaagugggaggaccaggccgagaucuccgggagcucccccauccugagcaucaccaucuccgaggacggcagcauguccaucaagaacgaggaggaggagcacacccugacgauccucauccggaccggccugcuggugaucagcggggucuucccgguguccauccccaucaccgccgccgcgugguaccucugggaggugaagaagcagcgcgccggcguccugugggacgugcccagcccgccgcccguggggaaggccgagcuggaggacggcgccuaccggaucaagcagcgcgggaucuucggcuacucccagaucggcgccggggucuacaaggagggcaccuuccacaccauguggcacgugacgcgcggggcggugcucaugcaccgcggcaagcggaucgagcccagcugggccgacgucaagaaggaccugaucuccuacgggggcggcuggaagcuggagggggaguggaaggagggcgaggagguccaggugcucgcccuggagcccgggaagaacccccgcgccguccagaccaagcccggccuguucaagaccaacaccgggacgaucggcgccgugagccucgacuucucccccggcaccagcgggucccccaucguggaccggaagggcaaggucguggggcuguacggcaacggcguggucacccgcagcggggcguacguguccgccaucgcccagaccgagaaguccaucgaggacaaccccgagaucgaggacgacaucuuccggaagaagcgccugacgaucauggaccuccaccccggcgccgggaagaccaagcgguaccugcccgcgaucgugcgcgaggccaucaagcggggccugcgcacccugauccucgccccgacccgcgucguggccgccgagauggaggaggcgcugcgggggcugcccauccgcuaccagacgcccgccauccgggccgagcacaccggccgcgagaucguggaccucaugugccacgccaccuucaccaugcggcugcugagccccguccgcgugccgaacuacaaccucaucaucauggacgaggcccacuucacggaccccgcguccaucgccgcccggggcuacaucagcacccgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggccggcaacgacaucgccgcgugccugcgcaagaacggcaagaaggucauccagcugagccggaagaccuucgacuccgaguacgugaagacccgcgccaacgacugggacuucguggucacgaccgacaucagcgagaugggggccaacuuccgggccgagcgcgugaucgacccccggcgcugcaugaagcccgugauccucaccgacggcgaggagcgggucauccuggccgggcccaugccggugacccacuccagcgcggcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgccaucgacggggaguaccgccugcggggcgaggcgcgcaagaccuucgucgaccucaugcggcgcggggaccugcccguguggcuggccuaccggguggccgccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcgcgcaucuacagcgacccccucgcccugaaggaguucaaggaguucgccgccggccggaagucccugacccucaaccugaucacggagauggggcgccugcccaccuucaugacccagaaggcgcgggacgcccucgacaaccuggccguccugcacaccgccgaggugggcgggcgcgccuacaaccacgcgcucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgccgcguccaucauccuggaguucuuccucaucguccugcugauccccgagcccgagaagcagcggacgccccaggacaaccagcucaccuacguggugaucgccauccugacggucguggccgccaccauggccaacgagaugggguuccuggagaagaccaagaaggaccucggccugggcagcaucaccacgcaggagagcgaguccaacauccuggacaucgaccuccgcccggcgagcgccuggacccuguacgccguggccaccaccuucgucacgcccaugcugcggcacuccaucgagaacagcuccgugaacgugagccucaccgccaucgcgaaccaggccaccguccugauggggcugggccgcggguggccccucuccaagauggacgugggcgugccccugcuggccaucgggugcuacagccaggucaacccgaucacccucacggccgcgcugcugcuccugguggcccacuacgccaucaucggccccggccugcaggccaaggccacccgcgaggcgcagaagcggaccgccgccgggaucaugaagaaccccaccguggacggcaucacggucaucgaccucgagcccaucccguacgaccccaaguucgagaagcagcugggccaggugaugcugcucgugcugugcgucacccaggugcugaugaugcgcaccaccugggcccucugcgaggcccugacgcuggcgaccggccccaucuccacccucugggaggggaaccccggccgguucuggaacaccacgaucgccgugagcauggccaacaucuuccgcggcuccuaccuggccggggccggccuccucuucagcaucaugaagaacaccaccaacacccggcgcgggacgggcaacaucggcgagacccugggggagaaguggaagucccggcugaacgcgcucggcaagagcgaguuccagaucuacaagaaguccgggauccaggaggucgaccgcacccuggccaaggagggcaucaagcgcggggagaccgaccaccacgccgugagccgcggcuccgccaagcugcggugguucguggagcgcaacauggucacgccggagggcaaggugguggaccucgggugcggccgcggcggguggagcuacuacugcggcgggcugaagaacguccgcgaggugaaggggcugaccaagggcgggcccgggcacgaggagcccauccccauguccaccuacggcuggaaccucgugcggcugcagagcggggucgacguguucuucaccccgcccgagaagugcgacacgcugcucugcgacaucggcgagagcucccccaaccccaccaucgaggcgggccgcacccugcgggugcugaaccucgucgagaacuggcugaacaacaacacccaguucugcgugaaggugcugaacccguacaugcccagcgucaucgagaagauggagacccuccagcgcaaguacgggggcgcccuggugcggaacccccugucccgcaacagcacgcacgagauguacuggguguccaacgccaccgggaacaucgucagcuccgugaacaugaucagccgcaugcugaucaaccgguucaccaugaagcacaagaaggccaccuacgagccggacguggaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagaccaagcagacgggcagcgcguccagcauggucaacgggguggugaagcugcucaccaagcccugggacgucgugccgauggugacccagauggccaugaccgacacgacccccuucggccagcagcgcgucuucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcccugggcgcgaucuucaccgacgagaacaaguggaaguccgcccgggaggccguggaggacucccgcuucugggagcugguggaccgggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcacaagcucggcuacauccugcgggacguguccaagaaggagggcggggccauguacgccgacgacaccgcggggugggacacgcgcaucacccuggaggaccucaagaacgaggagauggucaccaaccacaugaagggcgagcacaagaagcuggccgaggccaucuucaagcugaccuaccagaacaagguggugcggguccagcgcccgacgccccgcgggaccgugauggacaucaucagccggaaggaccagcgcggcuccggccagguggggaccuacggccucaacaccuucacgaacauggaggcccagcugauccggcagauggagggggagggcaucuucaagagcauccagcgccugaccgucaccgaggagaucgccgugcagaacuggcucgcgcgggugggccgcgagcggcugucccgcauggccaucagcggggacgacugcgucgugaagccccuggacgaccgguucgccuccgcccucaccgcccugaacgacaugggcaaggugcgcaaggacauccagcagugggagcccagccggggguggaacgacuggacgcaggucccguucugcucccaccacuuccacgagcuggugaugaaggacggccgcgugcucgucgugcccugccggaaccaggacgagcugaucgggcgcgcgcggaucagccagggcgccggcuggucccugaaggagaccgccugccucggcaagagcuacgcccagauguggacccugauguacuuccaccgccgggaccugcgccucgccgcgaacgccaucugcuccgccgugcccagccacuggguccccaccucccggaccacguggagcauccacgccaagcacgaguggaugaccaccgaggacaugcuggccguguggaaccgcguguggauccaggagaacccguggauggaggacaagacccccgucgaguccugggaggaggugcccuaccugggcaagcgcgaggaccaguggugcgggagccucaucggccugacgagccgggcgaccugggccaagaacauccagaccgccaucaaccaggugcgcucccugaucgggaacgaggaguacaccgacuacaugcccagcaugaagcgguuccgcaaggaggaggaggaggccggcguccucugguga

SEQ ID NO: 9414 - RNA, 9876 nt, Artificial Sequence
  derived and/or modified CDS sequence (opt1) from DENV-2__EU596491__SS-prME
accgccggcgucaucaucaugcugauccccaccgucauggccuuccaccucaccacccggaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgccauccuggcguacaccaucgggaccacgcacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaagaucgugcagcccgagaaccuggaguacaccaucgugaucacgccccacagcggggaggagcacgcggucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgccaagaagcaggacguggucgugcucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacgcccccgucaacaucgaggcggagccgcccuucggcgacagcuacaucaucguggggguggagccgggccagcugaagcucaacugguucaagaagggguccagcaucggccagauguucgagaccaccaugcgcggcgccaagcggauggccauccugggggacaccgccugggacuucggcucccucggcggggucuucacgagcaucgggaaggcccuccaccagguguucggggcgaucuacggcgccgccuucuccggggugagcuggaccaugaagauccugaucggcgucaucaucaccuggaucgggaugaacucccgcagcaccucccugagcgugucccuggugcucgucggcguggugacgcuguaccugggggccgucgugcaggcggacagcggcugcguggucuccuggaagaacaaggagcucaagugcggcagcgggaucuucaucaccgacaacgugcacaccuggaccgagcaguacaaguuccagcccgagucccccagcaagcuggccagcgccauccagaaggcccacgaggagggcaucugcgggauccgguccgugacgcgccuggagaaccucauguggaagcagaucacccccgagcugaaccacauccugagcgagaacgaggucaagcucaccaucaugaccggcgacaucaaggggaucaugcaggccggcaagcggucccugcgcccgcagcccacggagcugaaguacagcuggaagaccuggggcaaggcgaagaugcucuccaccgagagccacaaccagaccuuccugaucgacgggcccgagacggccgagugcccgaacaccaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacgcuguggagcaacggcgugcuggaguccgagaugaucauccccaagaacuucgccgggcccgugagccagcacaacuaccgcccgggcuaccacacccagaccgcggggcccuggcaccucggcaagcuggagauggacuucgacuucugcgaggggaccacgguggucgugaccgaggacugcggcaaccggggccccucccugcgcaccaccacggccagcgggaagcucaucaccgaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacgcgcgugggcaccaagcacgcgacccugcucgucgcccuguccuucgugacccugaucacggggaacaugagcuuccgggaccucggccgcgugauggucauggugggggccaccaugaccgacgacaucggcaugggcgugaccuaccuggcccugcucgccgcguucaagguccgccccacguucgccgccgggcugcugcuccggaagcugaccuccaaggagcugaugauggccaccaucggcaucgcccuccugagccaguccacccugcccgagacgauccucgagcugaccgacgcgcuggcccucgggaugauggugcugaagaucgugcgcaacauggagaaguaccagcuggccgucaccaucauggccaucagcugcgugccgaacgccgugauccuccagaacgcguggaaggucuccugcaccauccuggccgccgugagcgucagcccccugcuccugacgagcucccagcagaaggccgacuggaucccccuggcgcucaccaucaagggccugaaccccaccgccaucuuccugaccacgcucagccggaccuccaagaagcgcagcuggccgcugaacgaggccaucauggccgugggcaugguguccauccuggccagcucccuccugaagaacgacauccccaugaccgggccccuggucgcgggcgggcuccugaccgugugcuacgugcugacgggccggagcgccgaccucgagcuggagcgcgccgccgacgucaagugggaggaccaggccgagaucagcggguccagccccauccuguccaucaccaucagcgaggacggcuccaugagcaucaagaacgaggaggaggagcagacccucaccauccugauccggaccggccugcucgugaucuccgggguguucccggucagcauccccaucacggcggccgccugguaccugugggaggugaagaagcagcgcgccggcgugcugugggacguccccagcccgccgcccguggggaaggccgagcucgaggacggcgcguaccggaucaagcagcgcgggauccugggcuacagccagaucggcgccgggguguacaaggagggcaccuuccacaccauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcccucgagcccgggaagaacccccgcgcggugcagacgaagcccggcaucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucagccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucaucgacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccguggacggggaguaccggcuccgcggcgaggcccggaagacguucgucgaccugaugcgccgcggggaccugcccguguggcucgccuacaagguggccgcggagggcaucaacuacgccgaccgcaaguggugcuucgacgggaucaagaacaaccagauccuggaggagaacgucgagguggagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcaacgcccuggacaaccuggccguccuccacaccgcggaggugggcgggcgggcccacaaccacgcccuguccgagcugcccgagacccucgagacgcugcugcuccugacccugcucgccaccgugaccggcggcaucuuccuguuccugaugagcgggaagggcaucgggaagaugacccucggcaugugcugcaucaucacggccuccauccugcugugguacgcgcagauccagccgcacuggaucgccgccagcaucauccucgaguucuuccugaucguccugcucauccccgagcccgagaagcagcgcacgccccaggacaaccagcugaccuacguggugaucgccauccugaccgucguggccgcgacgauggccaacgagaugggguuccucgagaagaccaagaaggaccugggcuucggcuccaucaccacccaggagagcgagagcaacauccuggacaucgaccuccggccggccuccgccuggacgcuguacgccguggcgaccaccuucgucacccccaugcugcgccacagcaucgagaacuccagcgugaacgugucccucacggccaucgccaaccaggccaccguccugauggggcugggcaagggguggccccucagcaagauggacaucggcgugccccugcuggcgaucgggugcuacucccaggugaacccgaucacccucaccgccgcccugcugcuccuggucgcccacuacgccaucaucggccccggccugcaggcgaaggccacgcgggaggcccagaagcgcgccgccgcggggaucaugaagaaccccaccguggacggcaucaccgugaucgaccucgagcccaucccguacgaccccaaguucgagaagcagcuggggcaggucaugcugcucauccugugcgugacccaggugcugaugaugcggacgaccugggcccucugcgaggcccugacccuggccaccggccccaucagcacgcucugggaggggaaccccggccgcuucuggaacaccaccaucgccgucuccauggcgaacaucuuccgcggcagcuaccuggccggggccggccuccuguucuccaucaugaagaacaccacgaacacccggcgcgggaccggcaacgugggcgagacccugggggagaaguggaagucccggcugaacgcccucggcaaguccgaguuccagaucuacaagaaguccgggauccaggagguggaccgcacgcuggcgaaggagggcaucaagcgcggggagaccgaccaccacgccgucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcggccccgggcacgaggagcccauccccaugagcacguacggcuggaaccucgugcggcugcaguccgggguggacgucuucuucaccccgcccgagaagugcgacacccugcucugcgacaucggcgagagcagccccaaccccaccaucgaggccggccgcacccugcgggugcugaaccucguggagaacuggcugaacaacaacacgcaguucugcaucaagguccugaacccguacaugcccuccgugaucgagaagauggagacccuccagcgcaaguacgggggcgcccuggugcggaacccccugagccgcaacuccacccacgagauguacugggucagcaacgcgaccgggaacaucguguccagcgugaacaugaucucccggaugcugaucaaccgcuucacgaugaagcacaagaaggccaccuacgagccggacgucgaccucggcagcgggacccggaacaucggcaucgaguccgagauccccaaccuggacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggugaacggggugguccgccugcucaccaagcccugggacguggugccgauggucacgcagauggccaugaccgacaccacccccuucggccagcagcggguguucaaggagaagguggacacgcgcacccaggagcccaaggagggcaccaagaagcugaugaagaucaccgcggaguggcuguggaaggagcucgggaagaagaagacgccccggaugugcacccgcgaggaguucacccggaagguccgcuccaacgccgcccugggcgccaucuucaccgacgagaacaaguggaaguccgcccgggaggcgguggaggacgggcgcuucugggagcuggucgaccgggagcgcaaccuccaccuggagggcaagugcgagacgugcguguacaacaugauggggaagcgggagaagaagcugggcgaguucggcaaggccaaggggucccgcgccaucugguacauguggcucggcgcccgguuccuggaguucgaggcgcugggguuccucaacgaggaccacugguucagccgcggcaacucccugagcgggguggagggcgagggccugcaccggcucggguacauccugcgcgaggucggcaagaaggagggcggcgccauguacgccgacgacaccgccgggugggacacccggaucacccuggaggaccucaagaacgaggagauggugacgaaccacaugaagggcgagcacaagaagcuggccgaggcgaucuucaagcugaccuaccagaacaaggugguccgcgugcagcggccgacgccccggggcaccgugauggacaucaucagccggaaggaccagcgcggguccggccaggucgggacguacggccucaacaccuucaccaacauggaggcccagcugauccgccagauggagggcgaggggaucuucaagagcauccagcaccugaccgccacggaggagaucgccgugcagaacuggcucgcccgggugggccgcgagcggcugucccgcauggcgaucagcggggacgacugcgucgugaagcccaucgacgaccgguucgccuccgcccugaccgcccucaacgacaugggcaaggugcgcaaggacauccagcagugggagcccagccggggguggaacgacuggacccaggucccguucugcucccaccacuuccacgagcuggugaugaaggacggccgcgugcuggucgugcccugccggaaccaggacgagcucaucggccgcgcccggaucagccagggggcgggcuggucccugaaggagaccgccugccugggcaagagcuacgcccagauguggacccucauguacuuccaccgccgggaccugcgccuggccgccaacgcgaucugcuccgccgugcccagccacuggguccccacgucccggaccaccuggagcauccacgccaagcacgaguggaugaccacggaggacaugcucgccguguggaaccgcguguggauccaggagaacccguggauggaggacaagacccccgucgaguccugggaggaggugcccuaccugggcaagcgggaggaccaguggugcgggagccugaucggccucaccucccgcgcgaccugggccaagaacauccagacggccaucaaccaggugcggagccugaucggcaacgaggaguacaccgacuacaugcccagcaugaagcgcuuccgccgggaggaggaggaggccgggguccugugguga

SEQ ID NO: 9415 - RNA, 9876 nt, Artificial Sequence
  derived and/or modified CDS sequence (opt1) from DENV-2__EU677141__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcgguacguccuggggcgccugaucaccgugaacccgaucgugaccggcaaggacagccccgucaacaucgaggcggagccgcccuucggggacuccuacaucaucaucggcguggagccggggcagcucaagcugaacugguucaagaagggcagcuccaucggccagauguucgagaccacgaugcgcggggccaagcggauggccauccugggcgacaccgccugggacuucgggagccucggcgggguguucaccuccaucggcaaggcccugcaccaggucuucggcgcgaucuacggggccgccuucagcggcguguccuggaccaugaagauccugaucggggugaucaucacguggaucggcaugaacagccgcuccaccagccuguccgucagccucgugcuggugggggucgugacccuguaccucggcgugaugguccaggccgacuccggcugcguggugagcuggaagaacaaggagcugaagugcggguccggcaucuucaucaccgacaacguccacacguggaccgagcaguacaaguuccagcccgagagccccagcaagcuggcguccgccauccagaaggcccacgaggaggggaucugcggcauccggagcgugacccgccucgagaaccugauguggaagcagaucacccccgagcugaaccacauccucuccgagaacgaggugaagcugacgaucaugaccggggacaucaagggcaucaugcaggccggcaagcggagccugcgcccgcagcccaccgagcucaaguacuccuggaagaccugggggaaggccaagaugcugagcacggagucccacaaccagaccuuccugaucgacggccccgagaccgcggagugcccgaacaccaaccgggccuggaacagccucgaggucgaggacuacggguucggcguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggggugcucgaguccgagaugaucauccccaagaacuucgccggccccgugagccagcacaacuaccgcccgggguaccacacccagaccgccggccccuggcaccuggggaagcuggagauggacuucgacuucugcgagggcacgaccgugguggucaccgaggacugcggcaaccgggggcccagccuccgcaccacgaccgcguccggcaagcugaucaccgaguggugcugccggagcugcacccugcccccgcuccgcuaccgcggggaggacggcugcugguacgggauggagauccgcccccugaaggagaaggaggagaaccuggugaacucccucgugacggccggccacggccagaucgacaacuucagccuggggguccugggcauggcccucuuccuggaggagaugcugcggacccgcguggggaccaagcacgccauccuccugguggcggucuccuucgugacccugaucacgggcaacaugagcuuccgggaccucgggcgcgugauggucauggugggcgccaccaugaccgacgacaucggcaugggggugaccuaccuggcccugcucgccgccuucaagguccgccccacguucgcggccggccugcugcuccggaagcugaccuccaaggagcugaugauggccaccaucgggaucgcccuccugagccaguccaccauccccgagacgauccuggagcucaccgacgcccuggcgcugggcaugauggugcucaagaucgugcgcaacauggagaaguaccagcuggccgucaccaucauggccauccugugcgugccgaacgccgugauccuccagaacgccuggaaggucagcugcaccauccuggcggccguguccgucagcccccugcuccugacguccagccagcagaaggccgacuggaucccccuggcccucaccaucaagggccugaaccccaccgcgaucuuccugaccacgcucucccggaccagcaagaagcgcuccuggccgcugaacgaggccgugauggccguggggauggucagcauccuggccuccagccuccugaagaacgacauccccaugaccggcccccugguggccgggggccuccugaccgugugcuacguccugacggggcggagcgcggaccucgagcuggagcgcgccgccgacgugaagugggaggaccaggccgagaucuccggcagcucccccauccugagcaucaccaucuccgaggacggcagcauguccaucaagaacgaggaggaggagcagacccucaccauccugauccggacggggcugcucgugaucagcggcgucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagcgcggcaucuucggcuacucccagaucggggcgggcgucuacaaggaggggaccuuccacaccauguggcacgugacccggggcgccgugcugaugcaccgcgggaagcggaucgagcccagcugggccgacgucaagaaggaccugaucuccuacggcggcggguggaagcucgagggcgaguggaaggagggggaggagguccaggugcuggcccuggagcccggcaagaacccccgcgccguccagacgaagcccggccucuucaagaccaacaccggcaccaucggcgcggugagccuggacuucucccccgggacgagcggcucccccaucguggaccggaaggggaaggucgugggccuguacggcaacgggguggucacccgcagcggcgccuacguguccgccaucgcccagaccgagaaguccaucgaggacaaccccgagaucgaggacgacaucuuccggaagaagcgccucaccaucauggaccugcaccccggggcgggcaagacgaagcgguaccugcccgccaucgugcgcgaggccaucaagcgggggcugcgcacccucauccuggccccgacccgcgucguggccgcggagauggaggaggcccugcggggccuccccauccgcuaccagacccccgccauccgggccgagcacacgggccgcgagaucguggaccugaugugccacgccaccuucaccaugcggcugcucagccccguccgcgugccgaacuacaaccugaucaucauggacgaggcgcacuucaccgaccccgccuccaucgccgcccggggguacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucaccgacuucaagggcaagacggugugguucgugccguccaucaaggccggcaacgacaucgcggccugccugcgcaagaacgggaagaaggucauccagcucagccggaagaccuucgacuccgaguacgugaagacccgcgccaacgacugggacuucguggucaccacggacaucagcgagaugggcgccaacuuccgggccgagcgcgugaucgacccccggcgcugcaugaagcccgugauccugaccgacggggaggagcgggucauccuggcgggccccaugccggugacccacuccagcgccgcccagcgccgcgggcggaucggccgcaaccccaagaacgagaacgaccaguacaucuacaugggcgagccccucgagaacgacgaggacugcgcccacuggaaggaggccaagaugcugcuggacaacaucaacacccccgaggggaucaucccguccauguucgagcccgagcgggagaagguggacgcgaucgacggcgaguaccgccuccgcggggaggcccgcaagacguucgucgaccugaugcggcgcggcgaccugcccguguggcucgccuaccggguggccgccgaggggaucaacuacgcggaccgccgguggugcuucgacggcaucaagaacaaccagauccuggaggagaacgucgagguggagaucuggaccaaggagggcgagcgcaagaagcugaagccgcgguggcucgacgcccgcaucuacagcgacccccuggcccugaaggaguucaaggaguucgccgcggggcggaagucccucacccugaaccugaucaccgagaugggccgccuccccacguucaugacccagaaggcccgggacgcccuggacaaccuggccguccuccacaccgccgaggucggcgggcgcgcguacaaccacgcccugagcgagcugcccgagacccucgagacgcugcugcuccugacccugcucgccaccgugaccggcgggaucuuccuguuccugauguccgggaaggggaucggcaagaugacgcucgggaugugcugcaucaucaccgccagcauccugcugugguacgcccagauccagccgcacuggaucgcggccuccaucauccucgaguucuuccugaucguccugcucauccccgagcccgagaagcagcggacgccccaggacaaccagcugaccuacguggugaucgccauccugaccgucguggccgccacgauggcgaacgagaugggcuuccucgagaagaccaagaaggaccugggccuggggagcaucaucacccaggagagcgaguccaacauccucgacaucgaccugcgcccggccagcgccuggacccuguacgccguggccacgaccuucgucacccccaugcuccggcacuccaucgagaacagcuccgugaacgugagccugaccgcgaucgccaaccaggccacgguccugaugggccucgggcgcggcuggccccuguccaagauggacaucggggugccccugcucgccaucggcugcuacagccaggugaacccgaucacccugaccgcggcccugcuccugcuggucgcccacuacgccaucaucggccccgggcuccaggccaaggcgacccgcgaggcccagaagcgggccgccgccggcaucaugaagaaccccacgguggacgggaucaccgugaucgaccuggagcccaucccguacgaccccaaguucgagaagcagcugggccaggucaugcuccuggugcugugcgugacccagguccucaugaugcgcaccacgugggcgcugugcgaggcccugacccucgccaccgggcccaucuccacccugugggagggcaaccccggccgguucuggaacacgaccaucgccgugagcauggccaacaucuuccgcggguccuaccuggcgggcgccgggcuccuguucagcaucaugaagaacaccaccaacacgcggcgcggcaccggcaacaucggggagacccugggcgagaaguggaagucccggcucaacgcccugggcaagagcgaguuccagaucuacaagaaguccggcauccaggagguggaccgcacccuggccaaggaggggaucaagcggggcgagacggaccaccacgcggucagccgcggcuccgccaagcuccggugguucguggagcgcaacauggugaccccggaggggaaggucguggaccugggcugcgggcggggcggguggagcuacuacugcggcggccugaagaacgugcgcgaggucaaggggcucaccaagggcgggcccggccacgaggagcccauccccauguccaccuacggguggaaccuggugcggcugcagagcggcguggacgucuucuucacgccgcccgagaagugcgacacccuccugugcgacaucggcgagagcucccccaaccccaccaucgaggccgggcgcacccugcgggugcucaaccugguggagaacuggcugaacaacaacacgcaguucugcaucaagguccucaacccguacaugcccagcgugaucgagaagauggagacccugcagcgcaaguacggcggggcccuggugcggaacccccugucccgcaacagcacccacgagauguacugggucuccaacgccaccggcaacaucgugagcuccgugaacaugaucagccgcaugcucaucaaccgguucaccaugaagcacaagaaggcgacguacgagccggacgucgaccugggguccggcacccgcaacaucggcaucgagaacgagauccccaaccuggacaucaucgggaagcggaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccuccugaccaagcccugggacguggugccgauggucacccagauggccaugacggacaccacccccuucggccagcagcggguguucaaggagaagguggacacccgcacgcaggagcccaaggaggggaccaagaagcugaugcggaucaccgccgaguggcucuggaaggagcugggcaagaagaagacgccccggaugugcacgcgggaggaguucacccgcaagguccgguccaacgcggcccugggggccaucuucaccgacgagaacaaguggaaguccgcccgcgaggccguggaggacucccgguucugggagcucgucgaccgcgagcggaaccugcaccuggagggcaagugcgagaccugcguguacaacaugauggggaagcgcgagaagaagcucggcgaguucggcaaggcgaaggggagccgggccaucugguacauguggcugggcgcccgcuuccuggaguucgaggcccucggguuccugaacgaggaccacugguucucccggggcaacagccugagcgggguggagggcgagggccuccacaagcugggguacauccugcgcgacgucuccaagaaggagggcggggcgauguacgccgacgacacggccggcugggacacccggaucacccucgaggaccugaagaacgaggagauggugaccaaccacaugaagggggagcacaagaagcuggccgaggccaucuucaagcucacguaccagaacaaggugguccgcgugcagcgcccgacgccccggggcaccgugauggacaucaucagccgcaaggaccagcggggcuccgggcaggucggcaccuacgggcugaacacguucaccaacauggaggcgcagcugauccgccagauggagggcgagggcaucuucaagagcauccagcaccucaccgugaccgaggagaucgccgugcagaacuggcuggcccgggucgggcgcgagcggcugucccgcauggccaucagcggcgacgacugcguggugaagccccucgacgaccgguucgccuccgcgcugacggcccugaacgacauggggaagguccgcaaggacauccagcagugggagcccagccggggcuggaacgacuggacccaggugccguucugcucccaccacuuccacgagcucgugaugaaggacgggcgcguccugguggugcccugccggaaccaggacgagcugaucggccgcgcccggaucagccagggcgccggguggucccucaaggagaccgccugccugggcaagagcuacgcgcagauguggacccugauguacuuccaccgccgggaccuccgccuggccgccaacgccaucugcuccgccguccccagccacugggugcccacgucccggaccaccuggagcauccacgcgaagcacgaguggaugaccaccgaggacaugcuggccguguggaaccgcgucuggauccaggagaacccguggauggaggacaagacgcccguggaguccugggaggaggugcccuaccucgggaagcgcgaggaccaguggugcggcagccugaucgggcugaccagccgggccaccugggccaagaacauccagaccgcgaucaaccagguccgcucccucaucggcaacgaggaguacacggacuacaugcccagcaugaagcgguuccgcaaggaggaggaggaggccggcgugcugugguga

SEQ ID NO: 9416 - RNA, 9876 nt, Artificial Sequence
  derived and/or modified CDS sequence (opt1) from DENV-2__EU677144__SS-prME
accgccggcaugaucaucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccguggcccuggucccccacguggggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccgucgcgcccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcggcaucgugaccugcgcgauguucacgugcaagaagaacauggagggcaaggugguccugcccgagaaccuggaguacaccaucgugaucacgccccacagcggggaggagcacgccgugggcaacgacaccgggaagcacggcaaggagaucaagaucaccccgcaguccagcaucaccgaggccgagcucaccggguacggcacggucaccauggagugcagcccccggaccggccuggacuucaacgagauggugcugcuccagauggaggacaaggccuggcuggugcaccggcagugguuccuggaccucccccugcccuggcugccgggggccgacacccagggccucaacuggauccagaaggagacgcuggucaccuucaagaacccccacgcgaagaagcaggacguggugguccuggggagccaggagggcgccaugcacaccgcccucaccggggccacggagauccagauguccagcggcaaccugcuguucaccggccaccucaagugccgccugcggauggacaagcugcagcucaaggggaugagcuacuccaugugcaccggcaaguucaagaucgugaaggagaucgccgagacccagcacgggacgaucgucauccgcgugcaguacgagggcgacggcagccccugcaagauccccuucgagaucauggaccuggagaagcgguacgugcuggggcgccucaucaccgucaacccgaucgugaccgagaaggacucccccgugaacaucgaggcggagccgcccuucggcgacagcuacaucaucaucggggucgagccgggccagcugaagcugaacugguucaagaagggguccagcaucggccagauguucgagaccacgaugcgcggcgccaagcggauggccauccucggggacaccgccugggacuucggcucccucgggggcguguucaccagcaucgggaaggcccugcaccagguguucggcgcgaucuacggcgccgccuucuccggggucagcuggaccaugaagauccugaucggcgugaucaucacguggaucgggaugaacucccgcagcaccucccucagcgugucccugguccuggugggcguggucacccucuaccugggggugauggugcaggccgacagcggcugcgucguguccuggaagaacaaggagcugaagugcggcagcgggaucuucaucaccgacaacgugcacacguggaccgagcaguacaaguuccagcccgagucccccagcaagcucgcgagcgccauccagaaggcccacgaggagggcaucugcgggauccgguccgucacccgccuggagaaccugauguggaagcagaucacccccgagcucaaccacauccugagcgagaacgaggugaagcugacgaucaugaccggcgacaucaaggggaucaugcaggccggcaagcggucccuccgcccgcagcccaccgagcugaaguacagcuggaagaccuggggcaaggccaagaugcuguccacggagagccacaaccagaccuuccucaucgacgggcccgagaccgcggagugcccgaacaccaaccgggccuggaacucccuggagguggaggacuacggcuucggggucuucagcacgaacaucuggcugaagcuccgcgagaagcaggacguguucugcgacuccaagcugaugagcgccgccaucaaggacaaccgggccgugcacgcggacaugggcuacuggaucgaguccgcccugaacgacaccuggaagauggagaaggccagcuucaucgaggucaaguccugccacuggcccaagagccacacccucugguccaacggcgugcuggagagcgagaugaucauccccaagaacuucgccgggcccgugucccagcacaacuaccgcccgggcuaccacacccagaccgccgggcccuggcaccugggcaagcucgagauggacuucgacuucugcgaggggacgaccgucguggugaccgaggacugcggcaaccggggccccagccugcgcaccacgaccgcgagcgggaagcugaucaccgaguggugcugccgguccugcacccucccgccccugcgcuaccggggcgaggacgggugcugguacggcauggagauccgcccccugaaggagaaggaggagaaccucgucaacagccuggugacggccgggcacggccagaucgacaacuucucccugggcgugcucgggauggcccuguuccuggaggagaugcuccggacccgcgucggcaccaagcacgccauccugcugguggcggugagcuucgucacccucaucacggggaacauguccuuccgggaccugggccgcgugauggugauggucggggccaccaugaccgacgacaucggcaugggcgugaccuaccuggcccuccuggccgccuucaaggugcgccccacguucgcggccgggcugcuccugcggaagcugaccagcaaggagcucaugauggccaccaucggcaucgcccugcugucccagagcaccauccccgagacgauccucgagcugaccgacgcccuggcgcucgggaugaugguccugaagaucgugcgcaacauggagaaguaccagcuggccgugaccaucauggccauccucugcguccccaacgccgugauccugcagaacgccuggaagguguccugcaccauccuggcggccgucagcgugagcccccuccugcugacgagcucccagcagaaggccgacuggaucccccucgcccugaccaucaagggccugaaccccaccgcgaucuuccucaccacgcugagccggaccuccaagaagcgcagcuggccgcugaacgaggccgucauggccgugggcaugguguccauccucgccagcucccugcugaagaacgacauccccaugaccgggccccucgucgccggcgggcugcugaccgugugcuacgugcucacgggccggagcgcggaccuggagcuggagcgcgccgccgacgucaagugggaggaccaggccgagaucagcggguccagccccauccucuccaucaccaucagcgaggacggcuccaugagcaucaagaacgaggaggaggagcagacccugaccauccugauccggacgggccuccuggugaucuccgggguguucccggucagcauccccaucaccgccgcggccugguaccugugggaggugaagaagcagcgcgccggcgugcucugggacguccccagcccgccgcccauggagaaggccgagcuggaggacggggccuaccggaucaagcagcgcggcaucuucggguacagccagaucggcgcgggcguguacaaggaggggaccuuccacaccauguggcacgugacccggggcgccguccugaugcaccgcgggaagcggaucgagcccuccugggccgacgugaagaaggaccucaucagcuacggcgggggcuggaagcuggagggcgaguggaaggagggggaggaggugcagguccuggcccucgagcccggcaagaacccccgcgccgugcagacgaagcccgggcuguucaagaccaacaccggcaccaucggggcggugucccuggacuucagccccggcacguccggcagccccaucgucgaccggaaggggaagguggugggccucuacgggaacggcgucgugacccgcuccggcgccuacgugagcgccaucgcccagaccgagaaguccaucgaggacaaccccgagaucgaggacgacaucuuccggaagaagcgccugaccaucauggaccugcaccccggggcgggcaagacgaagcgguaccugcccgccaucguccgcgaggccaucaagcgggggcuccgcacccugauccuggccccgacccgcgugguggccgcggagauggaggaggcccuccggggccugcccauccgcuaccagacccccgccauccgggccgagcacacggggcgcgagaucgucgaccugaugugccacgccaccuucaccaugcggcuccugagccccgugcgcgugccgaacuacaaccugaucaucauggacgaggcgcacuucaccgaccccgccagcaucgccgcccggggcuacaucuccacgcgcgucgagaugggcgaggccgcggggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggccgggaacgacaucgcggccugccuccgcaagaacggcaagaaggugauccagcugucccggaagaccuucgacagcgaguacgugaagacccgcgccaacgacugggacuucgucgugaccacggacaucuccgagaugggcgccaacuuccgggccgagcgcgugaucgacccccggcgcugcaugaagcccgucauccugaccgacggggaggagcgggugauccucgcgggccccaugccggugacccacagcuccgccgcccagcgccgcgggcggaucggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgggagaaggucgacgcgaucgacggcgaguaccgccugcgcggggaggcccgcaagacguucguggaccugaugcggcgcggcgaccuccccguguggcuggccuaccgggucgccgccgaggggaucaacuacgcggaccgccgguggugcuucgacggcaucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgccgcgggccggaagucccugacccugaaccucaucaccgagaugggccgccugcccacguucaugacccagaaggcccgggacgcccuggacaaccucgccguccugcacaccgccgaggucgggggccgcgcguacaaccacgcccuguccgagcuccccgagacccuggagacgcugcuccugcugacccuccuggccaccgucaccgggggcaucuuccuguuccucaugagcggcaaggggaucggcaagaugacgcuggggaugugcugcaucaucaccgccuccauccugcucugguacgcccagauccagccgcacuggaucgcggccagcaucauccuggaguucuuccugaucgugcuccugauccccgagcccgagaagcagcggacgccccaggacaaccagcugaccuacguggucaucgccauccucaccgugguggccgccacgauggcgaacgagaugggcuuccuggagaagaccaagaaggaccuggggcucggcuccaucaucacccaggagagcgagagcaacauccuggacaucgaccugcgcccggccuccgccuggacccucuacgccgucgccacgaccuucgugacccccaugcugcggcacagcaucgagaacuccagcgugaacgucucccugaccgcgaucgccaaccaggccacggugcucaugggccuggggcgcggcuggccccugagcaagauggacaucggggugccccuccuggccaucggcugcuacucccaggucaacccgaucacccugaccgcggcccuccugcugcucguggcccacuacgccaucaucgggcccggccugcaggccaaggcgacccgcgaggcccagaagcgggccgccgccggcaucaugaagaaccccacgguggacgggaucaccgucaucgaccuggagcccaucccguacgaccccaaguucgagaagcagcucggccaggugaugcugcuggugcucugcgucacccaggugcugaugaugcgcaccacgugggcgcugugcgaggcccucacccuggccaccgggcccaucagcacccugugggagggcaaccccgggcgguucuggaacacgaccaucgccguguccauggccaacaucuuccgcggcagcuaccucgcgggcgccgggcugcuguucuccaucaugaagaacaccaccaacacgcggcgcggcaccgggaacaucggcgagacccucggcgagaaguggaagucccggcugaacgcccugggcaagagcgaguuccagaucuacaagaaguccgggauccaggaggucgaccgcacccucgccaaggaggggaucaagcggggcgagacggaccaccacgcggugucccgcgggagcgccaagcugcggugguucguggagcgcaacauggucaccccggagggcaaggugguggaccugggcugcgggcggggcgggugguccuacuacugcggcgggcucaagaacguccgcgaggugaagggccugaccaagggcgggcccggccacgaggagcccauccccaugagcaccuacggguggaaccuggugcggcuccaguccggcgucgacguguucuucacgccgcccgagaagugcgacacccugcugugcgacaucggggagagcagccccaaccccaccaucgaggccggccgcacccuccgggugcugaaccuggucgagaacuggcucaacaacaacacgcaguucugcaucaaggugcugaacccguacaugcccuccgugaucgagaagauggagacccugcagcgcaaguacggcggggcccugguccggaacccccucagccgcaacuccacccacgagauguacugggugagcaacgccaccggcaacaucguguccagcgucaacaugaucucccgcaugcugaucaaccgguucaccaugaagcacaagaaggcgacguacgagccggacguggaccuggggagcggcacccgcaacaucgggaucgagaacgagauccccaaccucgacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcugaccaagcccugggacguggucccgauggugacccagauggccaugacggacaccacccccuucgggcagcagcggguguucaaggagaaggucgacacccgcacgcaggagcccaaggagggcaccaagaagcucaugcggaucaccgccgaguggcuguggaaggagcugggcaagaagaagacgccccgcaugugcacgcgggaggaguucacccgcaaggugcggagcaacgcggcccucggggccaucuucaccgacgagaacaaguggaaguccgcccgcgaggccguggaggacagccgguucugggagcuggucgaccgcgagcggaaccugcaccucgagggcaagugcgagaccugcguguacaacaugauggggaagcgcgagaagaagcugggcgaguucgggaaggcgaagggcucccgggccaucugguacauguggcugggcgcccgcuuccucgaguucgaggcccugggguuccugaacgaggaccacugguucagccggggcaacucccucagcggggucgagggcgaggggcugcacaagcugggcuacauccuccgcgacgugagcaagaaggagggcggggcgauguacgccgacgacacggccggcugggacacccggaucacccuggaggaccugaagaacgaggagauggugaccaaccacaugaagggggagcacaagaagcucgccgaggccaucuucaagcugacguaccagaacaaggucgugcgcgugcagcgcccgacgccccggggcaccgucauggacaucaucucccgcaaggaccagcgggggagcggccaggugggcaccuacgggcugaacaccuucaccaacauggaggcgcagcucauccgccagauggagggcgaggggaucuucaaguccauccagcaccugaccgugaccgaggagaucgccguccggaacuggcuggcccgcgugggccgggagcgccucagccggauggccaucuccggcgacgacugcguggucaagccccuggacgaccgcuucgccagcgcgcugacggcccucaacgacauggggaaggugcggaaggacauccagcagugggagcccucccgcggcuggaacgacuggacccaggugccguucugcagccaccacuuccacgagcuggucaugaaggacgggcgggugcuggugguccccugccgcaaccaggacgagcucaucggccgggcccgcaucucccagggggccggcuggagccugaaggagaccgccugccugggcaaguccuacgcgcagauguggacccucauguacuuccaccggcgcgaccugcggcuggccgccaacgccaucugcagcgccgugcccucccacugggugcccacgagccgcaccaccugguccauccacgcgaagcacgaguggaugaccaccgaggacaugcucgccgucuggaaccgcguguggauccaggagaacccguggauggaggacaagacgcccguggagagcugggaggagguccccuaccuggggaagcgggaggaccaguggugcggcucccugaucgggcucaccagccgcgccaccugggccaagaacauccagaccgcgaucaaccaggugcggagccugaucggcaacgaggaguacacggacuacaugcccuccaugaagcgcuuccggaaggaggaggaggaggccggggugcugugguga

SEQ ID NO: 9417 - RNA, 9876 nt, Artificial Sequence
  derived and/or modified CDS sequence (opt1) from DENV-2__EU677145__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucaucaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcgggguguucaccuccaucgggaaggcccuccaccaggucuucggggcgaucuacggcgccgccuucagcgggguguccuggacgaugaagauccugaucggcgugaucaucaccuggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaaguccuucgccgggcccgugagccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccuccgggaagcucaucacggaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacccgcgucggcacgaagcacgcgauccugcucguggccguguccuucgucacccugaucaccgggaacaugagcuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccuccaaggagcugaugauggccacgaucggcaucgcccugcucagccaguccaccaugcccgagaccauccuggagcugaccgacgcgcucgcccuggggaugaugguccugaagaucgugcgcaacauggagaaguaccagcucgccgugacgaucauggccaucagcugcgucccgaacgccgugauccugcagaacgcguggaagguguccugcaccauccuggccaccgucagcgugagcccccuccugcugaccagcucccagcagaaggccgacuggaucccccucgcccugacgaucaagggccugaaccccaccgcgaucuuccucaccacccugagccggacguccaagaagcgcagcuggccgcugaacgaggccaucauggccgucggcaugguguccauccucgccagcagccugcugaagaacgacauccccaugaccgggccccucguggccggcgggcugcugaccgucugcuacgugcucaccggccgguccgcggaccuggagcuggagcgcgccgccgacgugaagugggaggaccaggccgagaucagcggguccagccccauccucuccaucacgaucagcgaggacggcuccaugagcaucaagaacgaggaggaggagcagacccugaccauccugauccggaccggccuccuggucaucuccgggguguucccggugagcauccccaucaccgccgcggccugguaccugugggaggucaagaagcagcgcgccggcgugcucugggacgugcccagcccgccgcccgucgggaaggccgagcuggaggacggcgccuaccggaucaagcagcgcgggauccugggcuacagccagaucggcgcggggguguacaaggagggcacguuccacaccauguggcacgugacccgcggggccguccucaugcaccgcggcaagcggaucgagcccuccugggccgacgugaagaaggaccugaucagcuacgggggcggcuggaagcuggagggggaguggaaggagggcgaggaggugcagguccucgcccuggagcccgggaagaacccccgcgccgugcagaccaagcccggcaucuucaagacgaacaccgggaccaucggcgcggugucccuggacuucagccccggcaccuccgggagccccaucgucgaccggaagggcaaggugguggggcucuacggcaacggcgucgugacgcgcuccggggccuacgugagcgccaucgcccagaccgagaaguccaucgaggacaaccccgagaucgaggacgacaucuuccggaagaagcgccugaccaucauggaccugcaccccggcgcggggaagaccaagcgguaccuccccgccaucguccgcgaggccaucaagcggggccugcgcacgcugauccuggccccgacccgcgugguggccgcggagauggaggaggcccuccgggggcugcccauccgcuaccagacccccgccauccgggccgagcacaccggccgcgagaucgucgaccugaugugccacgccacguucaccaugcggcuccugucccccgugcgcgugccgaacuacaaccugaucaucauggacgaggcgcacuucaccgaccccgccagcaucgccgcccggggcuacaucuccacccgcgucgagaugggggaggccgcgggcaucuucaugacggccacgccgcccgggagccgggacccguucccccaguccaacgcccccaucauggacgaggagcgcgagauccccgagcggagcuggaacuccggccacgagugggugaccgacuucaaggggaagaccgugugguucgucccgagcaucaaggccggcaacgacaucgcggccugccuccgcaagaacggcaagaaggugauccagcugucccggaagacguucgacagcgaguacgugaagacccgcgccaacgacugggacuucgucgugaccaccgacaucuccgagaugggggccaacuucaaggccgagcgggugaucgacccccgccggugcaugaagcccgucauccugacggacggcgaggagcgcgugauccucgcggggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagaaggucgacgcgaucgacggggaguaccggcugcgcggcgaggcccggaagaccuucguggaccugaugcgccgcggggaccuccccguguggcuggccuaccgcgucgccgccgagggcaucaacuacgcggaccggaaguggugcuucgacgggaucaagaacaaccagauccuggaggagaacguggagguggagaucuggacgaaggagggcgagcgcaagaagcucaagccgcgguggcuggacgcccgcaucuacuccgacccccuggcccucaaggaguucaaggaguucgccgcgggccggaagucccugacccugaaccucaucaccgagauggggcgccugcccaccuucaugacgcagaaggcccggaacgcccuggacaaccucgccguccugcacaccgccgaggcgggcgggcgcgccuacaaccacgcccuguccgagcuccccgagacccuggagacccugcuccugcugacgcuccuggccaccgugaccggcggcaucuuccuguuccucaugagcgggaagggcaucgggaagaugacccugggcaugugcugcaucaucaccgccuccauccugcucugguacgcgcagauccagccgcacuggaucgccgccagcaucauccuggaguucuuccugaucguccuccugauccccgagcccgagaagcagcggacgccccaggacaaccagcugaccuacguggugaucgccauccucaccgucguggccgcgaccauggccaacgagaugggguuccuggagaagacgaagaaggaccugggccucggcagcaucaccacccaggaguccgagagcaacauccuggacaucgaccugcgcccggccuccgccuggacccucuacgccguggcgacgaccuucgucacccccaugcugcggcacagcaucgagaacuccagcgugaacgugucccugaccgccaucgccaaccaggccacgguccucauggggcugggcaagggguggccccugagcaagauggacaucggcgugccccuccuggcgaucgggugcuacucccaggugaacccgaucacccugaccgccgcccuccugcugcucgucgcccacuacgccaucaucggccccggccugcaggcgaaggccacccgcgaggcccagaagcgggccgccgcggggaucaugaagaaccccacgguggacggcaucaccgugaucgaccuggagcccaucccguacgaccccaaguucgagaagcagcucgggcaggucaugcugcugauccucugcgugacccaggugcugaugaugcgcaccacgugggcccugugcgaggcccucacccuggccaccggccccaucagcacccugugggaggggaaccccggccgcuucuggaacacgaccaucgccgucuccauggcgaacaucuuccggggcagcuaccucgccggggccggccugcuguucuccaucaugaagaacaccaccaacacgcgccgggggaccggcaacaucggcgagacccucggggagaaguggaagucccgccugaacgcccugggcaaguccgaguuccagaucuacaagaaguccgggauccaggagguggaccggacccucgcgaaggagggcaucaagcgcggggagacggaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugaccaagggcgggcccgggcacgaggagcccguccccaugagcaccuacggcuggaaccuggugcgccuccagagcgggguggacgucuucuucacgccgcccgagaagugcgacacccugcugugcgacaucggcgaguccagccccaaccccaccaucgaggccggccggacccuccgcgugcugaaccugguggagaacuggcucaacaacaacacccaguucugcaucaagguccugaacccguacaugcccuccgugaucgagaagauggagacgcugcagcggaaguacgggggcgcccucgugcgcaacccccugagccggaacuccacccacgagauguacugggucagcaacgcgaccgggaacaucguguccagcgugaacaugaucucccgcaugcugaucaaccgguucaccaugaagcacaagaaggccacguacgagccggacgucgaccugggcagcgggacccgcaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggugguccggcugcugaccaagcccugggacguggugccgauggucacccagauggccaugacggacaccacccccuucggccagcagcgcguguucaaggagaagguggacacccggacgcaggagcccaaggagggcaccaagaagcucaugaagaucaccgcggaguggcuguggaaggagcuggggaagaagaagacgccccggaugugcacgcgggaggaguucaccaagaagguccgcuccaacgccgcccucggcgccaucuucaccgacgagaacaaguggaaguccgcccgggaggcgguggaggacgggcgcuucugggagcugguggaccgggagcgcaaccugcaccucgagggcaagugcgagaccugcgucuacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcggcaacagccucuccgggguggagggcgagggccugcaccggcugggguacauccuccgcgaggucggcaagaaggagggcggcgccauguacgccgacgacacggccgggugggacacccggaucacccuggaggaccugaagaacgaggagauggugaccaaccacaugaagggcgagcacaagaagcucgccgaggcgaucuucaagcugacguaccagaacaaggugguccgcgugcagcggccgacgccccgcggcaccgugauggacaucaucagccggcgcgaccagcgcggguccggccaggucgggaccuacggccugaacacguucaccaacauggaggcccagcucauccggcagauggagggcgaggggaucuucaagagcauccagcaccugaccgccaccgaggagaucgccgugcagaacuggcuggcccgcgugggccgggagcgccucucccggauggcgaucagcggggacgacugcgucgugaagcccaucgacgaccgcuucgccuccgcccugacggcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucggccgggcccgcaucagccagggggcgggcuggucccucaaggagaccgccugccugggcaagagcuacgcccagauguggacccugauguacuuccaccggcgcgaccuccggcuggccgccaacgcgaucugcuccgccgugcccagccacuggguccccaccucccgcacgaccuggagcauccacgccaagcacgaguggaugaccaccgaggacaugcuggccguguggaaccggguguggauccaggagaacccguggauggaggacaagacgcccgucgaguccugggaggaggugcccuaccucggcaagcgcgaggaccaguggugcgggagccugaucggccugaccagccgggcgaccugggccaagaacauccagaccgccaucaaccaggugcgcucccucaucggcaacgaggaguacacggacuacaugcccagcaugaagcgcuuccggcgcgaggaggaggaggccgggguccugugguga

SEQ ID NO: 9418 - RNA, 9876 nt, Artificial Sequence
  derived and/or modified CDS sequence (opt1) from DENV-2__EU677146__SS-prME
accgugggcgugaucgugaugcugauccccaccgccauggccuuccaccucaccacccgcaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccgcaccgagaccuggaugagcagcgagggggccuggaagcacgugcagcggaucgagaccuggauccugcgccacccgggcuucaccaucauggccgccauccuggcguacaccaucgggaccacccacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcggccuguucggcaagggcgggaucgugaccugcgccauguucacgugcaagaagaacauggagggcaaggugguccugcccgagaaccuggaguacaccaucgugaucacgccccacagcggggaggagcacgcggugggcaacgacaccgggaagcacggcaaggagaucaagaucaccccgcaguccagcaucaccgaggccgagcucaccggguacggcacggucaccauggagugcagcccccggaccggccuggacuucaacgagauggugcugcuccagauggaggacaaggccuggcuggugcaccggcagugguuccuggaccucccccugcccuggcugccgggggccgacacccagggcagcaacuggauccagaaggagacgcucgucaccuucaagaacccccacgccaagaagcaggacguggucgugcuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccucgagaagcggcacgugcuggggcgccugaucaccgucaacccgaucgugaccgagaaggacagccccgugaacaucgaggccgagccgcccuucggcgacuccuacaucaucaucggggucgagccgggccagcucaagcugaacugguucaagaaggggagcuccaucggccagauguucgagaccacgaugcgcggcgcgaagcggauggccauccugggggacaccgccugggacuucggcagccucgggggcguguucaccuccaucgggaaggcccugcaccagguguucggcgccaucuacggcgcggccuucagcggggucuccuggaccaugaagauccugaucggcgugaucaucacguggaucgggaugaacagccgcuccaccagccuguccgugagccucguccuggugggcguggucacccuguaccucggggugauggugcaggccgacuccggcugcgucgugagcuggaagaacaaggagcugaagugcggcuccgggaucuucaucaccgacaacgugcacacguggaccgagcaguacaaguuccagcccgagagccccagcaagcuggccuccgcgauccagaaggcccacgaggagggcaucugcgggauccggagcgucacccgccucgagaaccugauguggaagcagaucacccccgagcugaaccacauccucuccgagaacgaggccaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgagguggaggacuacggcuucgggguguucuccacgaacaucuggcugaagcugcgcgagaagcaggacgucuucugcgacagcaagcucauguccgccgccaucaaggacaaccgggccgugcacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgucagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcggaccgccgccgggaucaugaagaaccccaccguggacggcaucaccgugaucgaccucgagcccaucccguacgaccccaaguucgagaagcagcuggggcaggucaugcugcucgugcugugcgugacgcagguccugaugaugcgcaccaccugggcccucugcgaggcgcugacccuggccacgggccccaucagcacccucugggaggggaaccccggccgguucuggaacaccaccaucgccguguccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgucucccgcggcagcgcgaagcugcggugguucguggagcgcaacauggugaccccggagggcaaggucguggaccucgggugcggccgcggcgggugguccuacuacugcggcgggcugaagaacgugcgcgaggucaaggggcugacgaagggcgggcccgggcacgaggagcccauccccaugagcaccuacggcuggaaccucgugcggcugcagagcgggguggacgucuucuucaccccgcccgagaagugcgacacccugcucugcgacaucggcgaguccagccccaaccccacgaucgaggccggccgcacccugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccacggggaacaucguguccagcgugaacaugaucucccgcaugcugaucaaccgguucaccaugaagcacaagaaggccaccuacgagccggacgucgaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggugaacgggguggucaagcugcucacgaagcccugggacguggugccgauggucacccagauggccaugaccgacaccacgcccuucggccagcagcgcguguucaaggagaagguggacacccggacccaggagcccaaggagggcaccaagaagcugaugcgcaucacggccgaguggcuguggaaggagcucgggaagaagaagacgccccggaugugcacccgcgaggaguucacccggaagguccgcagcaacgccgcgcugggcgccaucuucacggacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggcgccauguacgcggacgacaccgccgggugggacacccgcaucacgcuggaggaccucaagaacgaggagauggugaccaaccacaugaagggcgagcacaagaagcuggccgaggccaucuucaagcugaccuaccagaacaaggugguccgggugcagcgcccgacgccccgggggacggugauggacaucaucucccggaaggaccagcgcggcagcggccaggucgggaccuacggccucaacaccuucaccaacauggaggcccagcugauccggcagauggagggggagggcaucuucaaguccauccagcgccugacggugaccgaggagaucgcggugcagaacuggcucgcccgggucggccgcgagcggcugagccgcauggccaucuccggggacgacugcguggugaagccccuggacgaccgguucgccagcgcccucaccgcgcugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccguccccucccacugggugcccaccagccggaccaccugguccauccacgccaagcacgaguggaugacgaccgaggacaugcuggcgguguggaaccgcgucuggauccaggagaacccguggauggaggacaagacccccguggagagcugggaggaggugcccuaccugggcaagcgcgaggaccaguggugcgggagccucaucggccugaccucccgggccacgugggccaagaacauccagaccgccaucaaccagguccgcagccugaucgggaacgaggaguacaccgacuacaugcccuccaugaagcgguuccgcaaggaggaggaggaggcgggcgugcucugguga

SEQ ID NO: 9419 - RNA, 9876 nt, Artificial Sequence
  derived and/or modified CDS sequence (opt1) from DENV-2__EU687214__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacgaacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccgcccggccagcgccuggacccuguacgccguggccaccaccuucgugacgcccaugcugcggcacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucuccacccucugggaggggaaccccggccgguucuggaacaccacgaucgccgucagcauggccaacaucuuccgcggcuccuaccuggccggggcgggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacauggugacgccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucaccccgcccgagaagugcgacacgcugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacgcacgagauguacugggucuccaacgccaccgggaacaucgugagcuccgugaacaugaucagccgcaugcugaucaaccgguucaccaugaagcacaagaaggccaccuacgagccggacgucgaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucagccggaaggaccagcgcggcuccggccaggucgggaccuacggccucaacaccuucacgaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucaucgcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagacggccugccucggcaagagcuacgcccagauguggacccugauguacuuccaccgccgggaccugcgccucgcggccaacgccaucugcuccgccguccccagccacugggugcccaccucccggaccaccuggagcauccacgccaagcacgaguggaugacgaccgaggacaugcuggcgguguggaaccgcgucuggauccaggagaacccguggauggaggacaagacccccguggaguccugggaggaggugcccuaccugggcaagcgcgaggaccaguggugcgggagccucaucggccugaccagccgggccacgugggccaagaacauccagaccgccaucaaccagguccgcucccugaucgggaacgaggaguacaccgacuacaugcccagcaugaagcgguuccgcaaggaggaggaggaggcgggcgugcucugguga

SEQ ID NO: 9420 - RNA, 9876 nt, Artificial Sequence
  derived and/or modified CDS sequence (opt1) from DENV-2__EU687215__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaagaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccgcccggccagcgccuggacccuguacgccguggccaccgcguucgugacccccaugcugcggcacuccaucgagaacagcuccgucaacgugagccucacggccaucgccaaccaggccaccgugcugauggggcugggccgcggguggccccucuccaagauggacaucggcgucccccugcuggcgaucgggugcuacagccaggugaacccgaucacccucaccgccgcccugcugcuccugguggcccacuacgccaucaucggccccggccugcaggcgaaggccacgcgcgaggcccagaagcggaccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcaccaccugggcgcucugcgaggcccugacccuggccacgggccccaucuccacccucugggaggggaaccccggccgguucuggaacaccaccaucgccgucagcauggccaacaucuuccgcggcuccuaccuggcgggggccggccuccucuucagcaucaugaagaacacgaccaacacccggcgcgggaccggcaacaucggcgagacgcugggggagaaguggaagucccggcugaacgcccucggcaagagcgaguuccagaucuacaagaaguccgggauccaggagguggaccgcacccuggccaaggagggcaucaagcgcggggagaccgaccaccacgcggugagccgcggcuccgccaagcugcggugguucgucgagcgcaacauggugaccccggagggcaagguggucgaccucgggugcggccgcggcggguggagcuacuacugcggcgggcugaagaacgugcgcgaggugaaggggcugacgaagggcgggcccgggcacgaggagcccauccccauguccaccuacggcuggaaccucguccggcugcagagcgggguggacguguucuucaccccgcccgagaagugcgacacccugcucugcgacaucggcgagagcucccccaaccccacgaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacccacgagauguacugggucuccaacgccacggggaacaucgugagcuccgugaacaugaucagccgcaugcugaucaaccgguucaccaugaagcacaagaaggcgaccuacgagccggacgucgaccucggcuccgggacccgcaacaucggcaucgagaacgagauccccaaccuggacaucaucggcaagcggaucgagaagaucaagcaggagcacgagacgagcuggcacuacgaccaggaccaccccuacaagaccugggccuaccacggguccuacgagaccaagcagaccggcagcgccuccagcauggugaacgggguggucaagcugcucacgaagcccugggacguggugccgauggucacccagauggccaugaccgacaccacgcccuucggccagcagcgcguguucaaggagaagguggacacccggacccaggagcccaaggagggcaccaagaagcugaugcgcaucacggccgaguggcuguggaaggagcucgggaagaagaagacgccccggaugugcacccgcgaggaguucacccggaagguccgcuccaacgcggcccugggcgccaucuucacggacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggcgauguacgccgacgacaccgccgggugggacacccgcaucacgcuggaggaccucaagaacgaggagauggugaccaaccacaugaagggcgagcacaagaagcuggccgaggccaucuucaagcugaccuaccagaacaaggugguccgggugcagcgcccgacgccccgggggacggugauggacaucaucagccggaaggaccagcgcggcuccggccaggucgggaccuacggccucaacaccuucaccaacauggaggcgcagcugauccggcagauggagggggagggcaucuucaagagcauccagcgccugacggugaccgaggagaucgccgugcagaacuggcucgcccgggucggccgcgagcggcugucccgcauggccaucagcggggacgacugcguggugaagccccuggacgaccgguucgccuccgcgcucaccgcccugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagacggccugccucggcaagagcuacgcgcagauguggacccugauguacuuccaccgccgggaccugcgccucgccgccaacgccaucugcuccgccguccccagccacugggugcccaccucccggaccaccuggagcauccacgcgaagcacgaguggaugacgaccgaggacaugcuggccguguggaaccgcgucuggauccaggagaacccguggauggaggacaagacccccguggaguccugggaggaggugcccuaccugggcaagcgcgaggaccaguggugcgggagccucaucggccugaccagccgggccacgugggccaagaacauccagaccgcgaucaaccagguccgcucccugaucgggaacgaggaguacaccgacuacaugcccagcaugaagcgguuccgcaaggaggaggaggaggccggcgugcucugguga

SEQ ID NO: 9421 - RNA, 9876 nt, Artificial Sequence
  derived and/or modified CDS sequence (opt1) from DENV-2__EU687216__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucaacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggugcugaagaucguccgcaacauggagaaguaccagcuggccgugaccaucauggccaucuccugcgugccgaacgccgucauccuccagaacgcguggaaggugagcugcaccauccuggccgccguguccgucagcccccugcuccugaccuccagccagcagaaggccgacuggaucccccuggcgcucacgaucaagggccugaaccccaccgccaucuuccugaccacccucucccggacgagcaagaagcgcuccuggccgcugaacgaggccaucauggccgugggcauggucagcauccuggccuccagccuccugaagaacgacauccccaugaccgggccccugguggcgggcgggcuccugaccgugugcuacguccugaccggccggagcgccgaccucgagcuggagcgcgccgccgacgugaagugggaggaccaggccgagaucuccgggagcucccccauccugagcaucacgaucuccgaggacggcagcauguccaucaagaacgaggaggaggagcagacccucaccauccugauccggaccggccugcucgugaucagcggggucuucccgguguccauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacucccagaucggcgccggggucuacaaggagggcacguuccacaccauguggcacgugacccgcggggccgugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggcaucuucaagacgaacaccgggaccaucggcgccgugagccuggacuucucccccggcaccagcgggucccccaucguggaccggaagggcaaggucguggggcuguacggcaacggcguggucacgcgcagcggggccuacguguccgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucagccccguccgcgugccgaacuacaaccugaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcucagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccugacggacggcgaggagcgcgucauccuggccgggcccaugccggugacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgcgagaagguggacgccaucgacggggaguaccggcuccgcggcgaggcccggaagaccuucgucgagcugaugcgccgcggggaccugcccguguggcucgccuacaagguggccgcggagggcaucaacuacgccgaccgcaaguggugcuucgacgggaucaagaacaaccagauccuggaggagaacgucgagguggagaucuggacgaaggagggcgagcggaagaagcugaagccgcgcuggcucgacgcccggaucuacagcgacccccuggcccugaaggaguucaaggaguucgcggccggccgcaagucccucacccugaaccugaucaccgagauggggcggcuccccaccuucaugacgcagaaggcccgcaacgcccuggacaaccuggccgugcuccacaccgcggaggucggcgggcgggccuacaaccacgcccugagcgagcugcccgagacccucgagacccugcugcuccugacgcugcucgccaccgugaccggcggcaucuuccuguuccugauguccgggaagggcgucgggaagaugacccucggcaugugcugcaucaucaccgccagcauccugcugugguacgcgcagauccagccgcacuggaucgccgccuccaucauccucgaguucuuccugaucgugcugcucauccccgagcccgagaagcagcgcacgccccaggacaaccagcugaccuacguggucaucgccauccugaccgugguggccgcgaccauggccaacgagaugggguuccucgagaagacgaagaaggaccugggcuucggcagcaucaccacccaggagagcgaguccaacauccuggacaucgaccuccggccggccagcgccuggacccuguacgccgucgcgacgaccuucaucacccccaugcugcgccacuccaucgagaacagcuccgugaacgugagccucaccgccaucgccaaccaggccacgguccugauggggcugggcaagggguggccccucuccaagauggacaucggcgugccccugcuggcgaucgggugcuacagccaggugaacccgaucacccucaccgccgcccugcugcuccuggucgcccacuacgccaucaucggccccggccugcaggcgaaggccacccgggaggcccagaagcgcgccgccgcggggaucaugaagaaccccacgguggacggcaucaccgugaucgaccucgagcccaucccguacgaccccaaguucgagaagcagcuggggcaggucaugcugcucauccugugcgugacccaggugcugaugaugcggaccacgugggcccucugcgaggcccugacccuggccaccggccccaucuccacccucugggaggggaaccccggccgcuucuggaacacgaccaucgccgucagcauggcgaacaucuuccgcggcuccuaccuggccggggccggccuccuguucagcaucaugaagaacaccaccaacacgcggcgcgggaccggcaacgugggcgagacccugggggagaaguggaagucccggcugaacgcccucggcaagagcgaguuccagaucuacaagaaguccgggauccaggagguggaccgcacccuggcgaaggagggcaucaagcgcggggagacggaccaccacgccgucagccgcggcuccgccaagcugcggugguucguggagcgcaacauggugaccccggagggcaaggucguggaccucgggugcggccgcgggggcuggagcuacuacugcgggggccugaagaacgugcgcgaggucaagggccugaccaagggcggccccgggcacgaggagcccauccccauguccaccuacggcuggaaccucgugcggcugcagagcgggguggacgucuucuucacgccgcccgagaagugcgacacccugcucugcgacaucggcgagagcucccccaaccccaccaucgaggccggccgcacccugcgggugcugaaccucguggagaacuggcugaacaacaacacccaguucugcaucaagguccugaacccguacaugcccagcgugaucgagaagauggagacgcuccagcgcaaguacgggggcgcccuggugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcucaccaagcccugggacguggugccgauggucacccagauggccaugacggacaccacccccuucggccagcagcggguguucaaggagaagguggacacccgcacgcaggagcccaaggagggcaccaagaagcugaugaagaucaccgcggaguggcuguggaaggagcucgggaaggagaagacgccccggaugugcacgcgcgaggaguucacccggaagguccgcagcaacgccgcccugggcgccaucuucaccgacgagaacaaguggaaguccgcccgggaggcgguggaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgccaucugguacauguggcucggcgcccgguuccuggaguucgaggcgcugggguuccucaacgaggaccacugguucucccgcggcaacagccugagcgggguggagggcgagggccugcaccggcucggguacauccugcgcgaggucggcaagaaggagggcggcgccauguacgccgacgacacggccgggugggacacccggaucacccuggaggaccucaagaacgaggagauggugaccaaccacaugaagggcgagcacaagaagcuggccgaggcgaucuucaagcugacguaccagaacaaggugguccgcgugcagcggccgacgccccggggcaccgugauggacaucaucucccggaaggaccagcgcgggagcggccaggucgggaccuacggccucaacacguucaccaacauggaggcccagcugauccgccagauggagggcgaggggaucuucaaguccauccagcaccugaccgccaccgaggagaucgccgugcagaacuggcucgcccgggugggccgcgagcggcugagccgcauggcgaucuccggggacgacugcgucgugaagcccaucgacgaccgguucgccagcgcccugacggcccucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucggccgcgcccggaucucccagggggcgggcuggagccugaaggagaccgccugccuggggaaguccuacgcccagauguggacccucauguacuuccaccgccgggaccugcgccuggccgccaacgcgaucugcagcgccgugcccucccacuggguccccaccagccggacgaccugguccauccacgccaagcacgaguggaugaccaccgaggacaugcucgccguguggaaccgcguguggauccaggagaacccguggauggaggacaagacgcccgucgagagcugggaggaggugcccuaccugggcaagcgggaggaccaguggugcgggucccugaucggccucaccagccgcgcgaccugggccaagaacauccagaccgccaucaaccaggugcggagccugaucggcaacgaggaguacacggacuacaugcccuccaugaagcgcuuccgccgggaggaggaggaggccgggguccugugguga

SEQ ID NO: 9422 - RNA, 9876 nt, Artificial Sequence
  derived and/or modified CDS sequence (opt1) from DENV-2__EU726770__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccgcccggccagcgccuggacccuguacgccguggccaccaccuucgugacgcccaugcugcggcacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucuccacccucugggaggggaaccccggccgguucuggaacaccacgaucgccgucagcauggccaacaucuuccgcggcuccuaccuggccggggcgggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacauggugacgccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucaccccgcccgagaagugcgacacgcugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacgcacgagauguacugggucuccaacgccaccgggaacaucgugagcuccgugaacaugaucagccgcaugcugaucaaccgguucaccaugaagcacaagaaggccaccuacgagccggacgucgaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcgggaccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccgggggaccgugauggacaucaucagccggaaggaccagcgcggcuccggccaggucgggaccuacggccucaacacguucaccaacauggaggcccagcugauccggcagauggagggggagggcaucuucaagagcauccagcgccugaccgugaccgaggagaucgccgugcagaacuggcucgcgcgggucggccgcgagcggcugucccgcauggccaucagcggggacgacugcguggugaagccccuggacgaccgguucgccuccgcccucacggcccugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcgcggaucagccagggcgccggcuggucccugaaggagaccgccugccucggcaagagcuacgcccagauguggacccugauguacuuccaccgccgggaccugcgccucgccgcgaacgccaucugcuccgccguccccagccacugggugcccaccucccggacgaccuggagcauccacgccaagcacgaguggaugaccaccgaggacaugcuggccguguggaaccgcgucuggauccaggagaacccguggauggaggacaagacgcccguggaguccugggaggaggugcccuaccugggcaagcgcgaggaccaguggugcgggagccucaucggccugaccagccgggcgaccugggccaagaacauccagaccgccaucaaccagguccgcucccugaucgggaacgaggaguacacggacuacaugcccagcaugaagcgguuccgcaaggaggaggaggaggccggcgugcucugguga

SEQ ID NO: 9423 - RNA, 9876 nt, Artificial Sequence
  derived and/or modified CDS sequence (opt1) from DENV-2__EU781135__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccaucauggccgucggcauggugagcauccuggccuccagccugcucaagaacgacauccccaugaccgggccccugguggccggcgggcugcucacggucugcuacgugcugaccggccggagcgcggaccuggagcucgagcgcgccgccgacgugaagugggaggaccaggccgagaucuccgggagcucccccauccugagcaucaccaucuccgaggacggcagcauguccaucaagaacgaggaggaggagcacacccugacgauccucauccggaccggccugcuggucaucagcgggguguucccgguguccauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacucccagaucggcgcggggguguacaaggagggcaccuuccacaccauguggcacgugacgcgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgccgugcagaccaagcccggccuguucaagaccaacaccgggacgaucggcgcggugagccucgacuucucccccggcaccagcgggucccccaucgucgaccggaagggcaaggugguggggcuguacggcaacggcgucgugacccgcagcggggccuacguguccgccaucgcccagaccgagaaguccaucgaggacaaccccgagaucgaggacgacaucuuccggaagaagcgccugacgaucauggaccuccaccccggcgcggggaagaccaagcgguaccugcccgccaucguccgcgaggccaucaagcggggccugcgcacccugauccucgccccgacccgcgugguggccgcggagauggaggaggcccugcgggggcugcccauccgcuaccagacgcccgccauccgggccgagcacaccggccgcgagaucgucgaccucaugugccacgccaccuucaccaugcggcugcugagccccgugcgcgugccgaacuacaaccucaucaucauggacgaggcgcacuucacggaccccgccuccaucgccgcccggggcuacaucagcacccgcgucgagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggccggcaacgacaucgcggccugccugcgcaagaacggcaagaaggugauccagcugagccggaagaccuucgacuccgaguacgugaagacccgcgccaacgacugggacuucgucgugacgaccgacaucagcgagaugggggccaacuuccgggccgagcgcgugaucgacccccggcgcugcaugaagcccgucauccucaccgacggcgaggagcgggugauccuggcggggcccaugccggugacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggagguggagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccguccugcacaccgccgaggugggcgggcgcgcguacaaccacgcccucagcgagcugcccgagacgcuggagacccuccugcugcucacccugcuggccaccgucacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacguggucaucgccauccugacggugguggccgccaccauggcgaacgagaugggguuccuggagaagaccaagaaggaccucggccugggcagcaucaccacgcaggagagcgaguccaacauccuggacaucgaccuccgcccggccagcgccuggacccuguacgccgucgccaccaccuucgugacgcccaugcugcggcacuccaucgagaacagcuccgugaacgucagccucaccgcgaucgccaaccaggccaccgugcugauggggcugggccgcggguggccccucuccaagauggacaucggcgugccccugcuggccaucgggugcuacagccaggucaacccgaucacccucacggcggcccugcugcuccugguggcccacuacgccaucaucggccccggccugcaggccaaggcgacccgcgaggcccagaagcggaccgccgccgggaucaugaagaaccccaccguggacggcaucacggucaucgaccucgagcccaucccguacgaccccaaguucgagaagcagcugggccaggugaugcugcucgugcugugcgucacccaggugcugaugaugcgcaccaccugggcccucugcgaggcgcugacgcuggccaccggccccaucuccacccucugggaggggaaccccggccgguucuggaacaccacgaucgccgugagcauggccaacaucuuccgcggcuccuaccuggccggggcgggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggaggucgaccgcacccuggccaaggagggcaucaagcgcggggagaccgaccaccacgccgugagccgcggcuccgcgaagcugcggugguucguggagcgcaacauggucacgccggagggcaaggugguggaccucgggugcggccgcggcggguggagcuacuacugcggcgggcugaagaacguccgcgaggugaaggggcugaccaagggcgggcccgggcacgaggagcccauccccauguccaccuacggcuggaaccucgugcggcugcagagcggggucgacguguucuucaccccgcccgagaagugcgacacgcugcucugcgacaucggcgagagcucccccaaccccaccaucgaggccggccgcacccugcgggugcugaaccucgucgagaacuggcugaacaacaacacccaguucugcgugaaggugcugaacccguacaugcccagcgucaucgagaagauggagacccuccagcgcaaguacgggggcgcccuggugcggaacccccugucccgcaacagcacgcacgagauguacuggguguccaacgccaccgggaacaucgucagcuccgugaacaugaucagccgcaugcugaucaaccgguucaccaugaagcacaagaaggccaccuacgagccggacguggaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggucaacgggguggugaagcugcucaccaagcccugggacgucgugccgauggugacccagauggccaugaccgacacgacccccuucggccagcagcgcgucuucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaaggugcgcuccaacgccgcgcugggcgccaucuucaccgacgagaacaaguggaaguccgcccgggaggccgucgaggacucccgcuucugggagcugguggaccgggagcgcaaccuccaccuggaggggaagugcgagaccugcgucuacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacguguccaagaaggagggcggggccauguacgcggacgacaccgccgggugggacacgcgcaucacccuggaggaccucaagaacgaggagauggucaccaaccacaugaagggcgagcacaagaagcuggccgaggccaucuucaagcugaccuaccagaacaagguggugcggguccagcgcccgacgccccgcgggaccgugauggacaucaucagccggaaggaccagcgcggcuccggccagguggggaccuacggccucaacaccuucacgaacauggaggcccagcugauccggcagauggagggggagggcaucuucaagagcauccagcgccugaccgucaccgaggagaucgcggugcagaacuggcucgcccgggugggccgcgagcggcugucccgcauggccaucagcggggacgacugcgucgugaagccccuggacgaccgguucgccuccgcccucaccgcgcugaacgacaugggcaaggugcgcaaggacauccagcagugggagcccagccggggguggaacgacuggacgcaggucccguucugcucccaccacuuccacgagcuggugaugaaggacggccgcgugcucgucgugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccgugcccagccacuggguccccaccucccggaccacguggagcauccacgccaagcacgaguggaugaccaccgaggacaugcuggcgguguggaaccgcguguggauccaggagaacccguggauggaggacaagacccccgucgaguccugggaggaggugcccuaccugggcaagcgcgaggaccaguggugcgggagccucaucggccugacgagccgggccaccugggccaagaacauccagaccgccaucaaccaggugcgcucccugaucgggaacgaggaguacaccgacuacaugcccagcaugaagcgguuccgcaaggaggaggaggaggcgggcguccucugguga

SEQ ID NO: 9424 - RNA, 9876 nt, Artificial Sequence
  derived and/or modified CDS sequence (opt1) from DENV-2__EU687222__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcggaccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcaccaccugggcccucugcgaggcgcugacccuggccacgggccccaucagcacccucugggaggggaaccccggccgguucuggaacaccaccaucgccgucuccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcagagcgggguggacguguucuucaccccgcccgagaagugcgacacccugcucugcgacaucggcgaguccagccccaaccccacgaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccacggggaacaucgucuccagcgugaacaugaucucccgcaugcugaucaaccgguucaccaugaagcacaagaaggccaccuacgagccggacguggaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugaagcugcucacgaagcccugggacgucgugccgauggugacccagauggccaugaccgacaccacgcccuucggccagcagcgcgucuucaaggagaagguggacacccggacccaggagcccaaggagggcaccaagaagcugaugcgcaucacggccgaguggcuguggaaggagcucgggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggggccauguacgcggacgacaccgccgggugggacacccgcaucacgcuggaggaccucaagaacgaggagauggucaccaaccacaugaagggcgagcacaagaagcuggccgaggccaucuucaagcugaccuaccagaacaagguggugcggguccagcgcccgacgccccgggggacggugauggacaucaucucccggaaggaccagcgcggcagcggccagguggggaccuacggccucaacaccuucaccaacauggaggcccagcugauccggcagauggagggggagggcaucuucaaguccauccagcgccugacggucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccgugcccucccacuggguccccaccagccggaccaccugguccauccacgccaagcacgaguggaugacgaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9425 - RNA, 9876 nt, Artificial Sequence
  derived and/or modified CDS sequence (opt1) from DENV-2__EU687223__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccggcaaggacagccccgucaacaucgaggcggagccgcccuucggggacuccuacaucaucaucggcguggagccggggcagcucaagcugaacugguucaagaagggcagcuccaucggccagauguucgagaccacgaugcgcggggccaagcggauggccauccugggcgacaccgccugggacuucgggagccucggcgggguguucaccuccaucggcaaggcccugcaccaggucuucggcgcgaucuacggggccgccuucagcggcguguccuggaccaugaagauccugaucggggugaucaucacguggaucggcaugaacagccgcuccaccagccuguccgucagccucgugcuggugggggucgugacccuguaccucggcgugaugguccaggccgacuccggcugcguggugagcuggaagaacaaggagcugaagugcggguccggcaucuucaucaccgacaacguccacacguggaccgagcaguacaaguuccagcccgagagccccagcaagcuggcguccgccauccagaaggcccacgaggaggggaucugcggcauccggagcgugacccgccucgagaaccugauguggaagcagaucacccccgagcugaaccacauccucuccgagaacgaggugaagcugacgaucaugaccggggacaucaagggcaucaugcaggccggcaagcggagccugcgcccgcagcccaccgagcucaaguacuccuggaagaccugggggaaggccaagaugcugagcacggagucccacaaccagaccuuccugaucgacggccccgagaccgcggagugcccgaacaccaaccgggccuggaacagccucgaggucgaggacuacggguucggcguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggggugcucgaguccgagaugaucauccccaagaacuucgccggccccgugagccagcacaacuaccgcccgggguaccacacccagaccgccggccccuggcaccuggggaagcuggagauggacuucgacuucugcgagggcacgaccgucguggugaccgaggacugcggcaaccgggggcccagccuccgcaccacgaccgcguccggcaagcugaucaccgaguggugcugccggagcugcacccugcccccgcuccgcuaccgcggggaggacggcugcugguacgggauggagauccgcccccugaaggagaaggaggagaaccuggucaacucccucgugacggccggccacggccagaucgacaacuucagccugggggugcugggcauggcccucuuccuggaggagaugcugcggacccgcgucgggaccaagcacgccauccuccugguggcgguguccuucgucacccugaucacgggcaacaugagcuuccgggaccucgggcgcgugauggugauggucggcgccaccaugaccgacgacaucggcaugggggugaccuaccuggcccugcucgccgccuucaaggugcgccccacguucgcggccggccugcugcuccggaagcugaccuccaaggagcugaugauggccaccaucgggaucgcccuccugagccaguccaccauccccgagacgauccuggagcucaccgacgcccuggcgcugggcaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccguggggaugguguccauccuggccagcagccugcucaagaacgacauccccaugaccggcccccuggucgccgggggccugcucaccgugugcuacgugcugacggggcgguccgcggaccuggagcucgagcgcgccgccgacgucaagugggaggaccaggccgagaucagcggcuccagccccauccuguccaucaccaucagcgaggacggcuccaugagcaucaagaacgaggaggaggagcacacccugaccauccucauccggacggggcugcuggugaucuccggcgccuucccggugagcauccccaucaccgcggccgccugguaccucugggaggucaagaagcagcgcgccggggugcugugggacgugcccagcccgccgcccgucggcaaggccgagcuggaggacggggcguaccggaucaagcagcgcggcaucuucggcuacagccagaucggggccggcguguacaaggaggggaccuuccacaccauguggcacgugacccggggcgccguccucaugcaccgcgggaagcggaucgagcccuccugggccgacgugaagaaggaccugaucagcuacggcggcggguggaagcuggagggcgaguggaaggagggggaggaggugcagguccucgcccuggagcccggcaagaacccccgcgcggugcagacgaagcccgggcuguucaagaccaacaccggcaccaucggcgccgugucccucgacuucagccccgggacguccggcagccccaucgucgaccggaaggggaagguggugggccuguacggcaacggggucgugacccgcuccggcgccuacgugagcgccaucgcgcagaccgagaaguccaucgaggacaaccccgagaucgaggacgacaucuuccggaagaagcgccugaccaucauggaccuccaccccggggccggcaagacgaagcgguaccugcccgccaucguccgcgaggccaucaagcgggggcugcgcacccugauccucgccccgacccgcgugguggcggccgagauggaggaggcccugcggggccugcccauccgcuaccagacccccgccauccgggccgagcacacgggccgcgagaucgucgaccucaugugccacgcgaccuucaccaugcggcugcugucccccgugcgcgugccgaacuacaaccucaucaucauggacgaggcccacuucaccgaccccgccagcaucgccgcccggggguacaucuccacgcgcgucgagaugggcgaggcggccgggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggcgggcaacgacaucgccgccugccugcgcaagaacgggaagaaggugauccagcugucccggaagaccuucgacagcgaguacgugaagacccgcgccaacgacugggacuucgucgugaccacggacaucuccgagaugggcgccaacuuccgggcggagcgcgugaucgacccccggcgcugcaugaagcccgucauccucaccgacggggaggagcgggugauccuggccggccccaugccggugacccacagcuccgccgcccagcgccgcgggcggaucggccgcaaccccaagaacgagaacgaccaguacaucuacaugggcgagccccuggagaacgacgaggacugcgcccacuggaaggaggcgaagaugcuccuggacaacaucaacacccccgaggggaucaucccgagcauguucgagcccgagcgggagaaggucgacgccaucgacggcgaguaccgccugcgcggggaggcccgcaagacguucguggaccucaugcggcgcggcgaccugcccguguggcuggccuaccgggucgccgcggaggggaucaacuacgccgaccgccgguggugcuucgacggcaucaagaacaaccagauccucgaggagaacguggagguggagaucuggaccaaggagggcgagcgcaagaagcugaagccgcgguggcuggacgcccgcaucuacuccgacccccucgcccugaaggaguucaaggaguucgcggccgggcggaagucccugacccucaaccugaucaccgagaugggccgccugcccacguucaugacccagaaggcccgggacgcccucgacaaccuggccguccugcacaccgcggaggucgggggccgcgccuacaaccacgcccucuccgagcugcccgagacccuggagacgcuccugcugcucacccugcuggccaccgucaccggcgggaucuuccucuuccugaugagcggcaaggggaucggcaagaugacgcuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgacgauggccaacgagaugggcuuccuggagaagaccaagaaggaccucggccuggggagcaucaccacccaggaguccgagagcaacauccuggacaucgaccuccgcccggccuccgccuggacgcuguacgccgucgcgaccaccuucgugacccccaugcugcggcacagcaucgagaacuccagcgugaacgucucccucacggccaucgccaaccaggccaccgugcugaugggccuggggcgcggcuggccccucagcaagauggacaucggggugccccugcuggcgaucggcugcuacucccaggucaacccgaucacccucaccgccgcccugcugcuccugguggcccacuacgccaucaucggccccgggcugcaggcgaaggccacgcgcgaggcccagaagcggaccgccgccggcaucaugaagaaccccaccguggacgggaucaccgucaucgaccucgagcccaucccguacgaccccaaguucgagaagcagcugggccaggugaugcugcucgugcugugcgucacccaggugcugaugaugcgcaccaccugggcgcucugcgaggcccugacccuggccacggggcccaucagcacccucugggagggcaaccccggccgguucuggaacaccaccaucgccguguccauggccaacaucuuccgcgggagcuaccuggcgggcgccgggcuccucuucuccaucaugaagaacacgaccaacacccggcgcggcaccggcaacaucggggagacgcugggcgagaaguggaagucccggcugaacgcccucgggaaguccgaguuccagaucuacaagaaguccggcauccaggaggucgaccgcacccuggccaaggaggggaucaagcggggcgagaccgaccaccacgcggugucccgcggcagcgccaagcugcggugguucguggagcgcaacauggucaccccggaggggaaggugguggaccucggcugcgggcggggcgggugguccuacuacugcggcggccugaagaacguccgcgaggugaaggggcugacgaagggcgggcccggccacgaggagcccauccccaugagcaccuacggguggaaccucgugcggcugcagagcggcgucgacguguucuucaccccgcccgagaagugcgacacccugcucugcgacaucggcgaguccagccccaaccccacgaucgaggccgggcgcacccugcgggugcugaaccucgucgagaacuggcugaacaacaacacccaguucugcaucaaggugcugaacccguacaugcccuccgugaucgagaagauggagacccuccagcgcaaguacggcggggcccugguccggaacccccugagccgcaacuccacccacgagauguacugggugagcaacgccacgggcaacaucguguccagcgucaacaugaucucccgcaugcugaucaaccgguucaccaugaagcacaagaaggcgaccuacgagccggacguggaccucgggagcggcacccgcaacaucggcaucgagaacgagauccccaaccuggacaucaucgggaagcggaucgagaagaucaagcaggagcacgagacguccuggcacuacgaccaggaccaccccuacaagaccugggccuaccacggcagcuacgagaccaagcagaccggguccgccagcuccauggugaacggcgucgugaagcugcucacgaagcccugggacguggucccgauggugacccagauggccaugaccgacaccacgcccuucggccagcagcgcguguucaaggagaaggucgacacccggacccaggagcccaaggaggggaccaagaagcugaugcgcaucacggccgaguggcuguggaaggagcucggcaagaagaagacgccccggaugugcacccgcgaggaguucacccggaaggugcgcagcaacgcggcccugggggccaucuucacggacgagaacaaguggaaguccgcccgggaggccguggaggacagccgcuucugggagcuggucgaccgggagcgcaaccuccaccuggagggcaagugcgagaccugcguguacaacaugauggggaagcgggagaagaagcugggcgaguucggcaaggcgaaggggucccgcgccaucugguacauguggcucggcgcccgguuccuggaguucgaggcccugggguuccucaacgaggaccacugguucagccgcggcaacagccuguccggggucgagggcgagggccugcacaagcucggguacauccugcgggacgugagcaagaaggagggcggggcgauguacgccgacgacaccgccggcugggacacccgcaucacgcuggaggaccucaagaacgaggagauggugaccaaccacaugaagggggagcacaagaagcuggccgaggccaucuucaagcugaccuaccagaacaaggucgugcgggugcagcgcccgacgccccggggcacggucauggacaucaucucccggaaggaccagcgcggcagcggccagguggggaccuacgggcucaacaccuucaccaacauggaggcgcagcugauccggcagauggagggcgagggcaucuucaaguccauccagcgccugacggugaccgaggagaucgccguccagaacuggcucgcccggguggggcgcgagcggcugagccgcauggccaucuccggcgacgacugcguggucaagccccuggacgaccgguucgccagcgcgcucaccgcccugaacgacauggggaaggugcgcaaggacauccagcagugggagcccucccggggcuggaacgacuggacccaggugccguucugcagccaccacuuccacgagcuggucaugaaggacgggcgcgugcucgugguccccugccggaaccaggacgagcugaucggccgcgcccggaucucccagggcgccggguggagccugaaggagacggccugccucggcaaguccuacgcgcagauguggacccugauguacuuccaccgccgggaccugcgccucgccgccaacgccaucugcagcgccgugcccucccacugggugcccaccagccggaccaccugguccauccacgcgaagcacgaguggaugacgaccgaggacaugcuggccgucuggaaccgcguguggauccaggagaacccguggauggaggacaagacccccguggagagcugggaggagguccccuaccuggggaagcgcgaggaccaguggugcggcagccucaucgggcugaccucccgggccacgugggccaagaacauccagaccgcgaucaaccaggugcgcagccugaucggcaacgaggaguacaccgacuacaugcccuccaugaagcgguuccgcaaggaggaggaggaggccggcgugcucugguga

SEQ ID NO: 9426 - RNA, 9876 nt, Artificial Sequence
  derived and/or modified CDS sequence (opt1) from DENV-2__EU687227__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcggaccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcaccaccugggcccucugcgaggcgcugacccuggccacgggccccaucagcacccucugggaggggaaccccggccgguucuggaacaccaccaucgccgucuccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcagagcgggguggacguguucuucaccccgcccgagaagugcgacacccugcucugcgacaucggcgaguccagccccaaccccacgaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccacggggaacaucgucuccagcgugaacaugaucucccgcaugcugaucaaccgguucaccaugaagcacaagaaggccaccuacgagccggacguggaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugaagcugcucacgaagcccugggacgucgugccgauggugacccagauggccaugaccgacaccacgcccuucggccagcagcgcgucuucaaggagaagguggacacccggacccaggagcccaaggagggcaccaagaagcugaugcgcaucacggccgaguggcuguggaaggagcucgggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggggccauguacgcggacgacaccgccgggugggacacccgcaucacgcuggaggaccucaagaacgaggagauggucaccaaccagaugaagggcgagcacaagaagcuggccgaggccaucuucaagcugaccuaccagaacaagguggugcggguccagcgcccgacgccccgggggacggugauggacaucaucucccggaaggaccagcgcggcagcggccagguggggaccuacggccucaacaccuucaccaacauggaggcccagcugauccggcagauggagggggagggcaucuucaaguccauccagcgccugacggucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccgugcccucccacuggguccccaccagccggaccaccugguccauccacgccaagcacgaguggaugacgaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9427 - RNA, 9876 nt, Artificial Sequence
  derived and/or modified CDS sequence (opt1) from DENV-2__EU687228__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaacgagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcggaccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcaccaccugggcccucugcgaggcgcugacccuggccacgggccccaucagcacccucugggaggggaaccccggccgguucuggaacaccaccaucgccgucuccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcagagcgggguggacguguucuucaccccgcccgagaagugcgacacccugcucugcgacaucggcgaguccagccccaaccccacgaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccacggggaacaucgucuccagcgugaacaugaucucccgcaugcugaucaaccgguucaccaugaagcacaagaaggccaccuacgagccggacguggaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugaagcugcucacgaagcccugggacgucgugccgauggugacccagauggccaugaccgacaccacgcccuucggccagcagcgcgucuucaaggagaagguggacacccggacccaggagcccaaggagggcaccaagaagcugaugcgcaucacggccgaguggcuguggaaggagcucgggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggggccauguacgcggacgacaccgccgggugggacacccgcaucacgcuggaggaccucaagaacgaggagauggucaccaaccacaugaagggcgagcacaagaagcuggccgaggccaucuucaagcugaccuaccagaacaagguggugcggguccagcgcccgacgccccgggggacggugauggacaucaucucccggaaggaccagcgcggcagcggccagguggggaccuacggccucaacaccuucaccaacauggaggcccagcugauccggcagauggagggggagggcaucuucaaguccauccagcgccugacggucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccgugcccucccacuggguccccaccagccggaccaccugguccauccacgccaagcacgaguggaugacgaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9428 - RNA, 9876 nt, Artificial Sequence
  derived and/or modified CDS sequence (opt1) from DENV-2__EU687230__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcggcaccucccugagcgucucccucgugcuggugggggucgugacccuguaccucggcgugaugguccaggccgacagcggcugcgugguguccuggaagaacaaggagcugaagugcgggagcggcaucuucaucaccgacaacguccacacguggaccgagcaguacaaguuccagcccgagucccccagcaagcuggcgagcgccauccagaaggcccacgaggaggggaucugcggcauccgguccgugacccgccucgagaaccugauguggaagcagaucacccccgagcugaaccacauccucagcgagaacgaggugaagcugacgaucaugaccggggacaucaagggcaucaugcaggccggcaagcggucccugcgcccgcagcccaccgagcucaaguacagcuggaagaccugggggaaggccaagaugcuguccacggagagccacaaccagaccuuccugaucgacggccccgagaccgcggagugcccgaacaccaaccgggccuggaacucccucgaggucgaggacuacggguucggcguguucagcacgaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggggugcucgagagcgagaugaucauccccaagaacuucgccggccccgugucccagcacaacuaccgcccgggguaccacacccagaccgccggccccuggcaccuggggaagcuggagauggacuucgacuucugcgagggcacgaccgucguggugaccgaggacugcggcaaccgggggcccagccuccgcaccacgaccgcgagcggcaagcugaucaccgaguggugcugccgguccugcacccugcccccgcuccgcuaccgcggggaggacggcugcugguacgggauggagauccgcccccugaaggagaaggaggagaaccuggucaacagccucgugacggccggccacggccagaucgacaacuucucccugggggugcugggcauggcccucuuccuggaggagaugcugcggacccgcgucgggaccaagcacgccauccuccugguggcggugagcuucgucacccugaucacgggcaacauguccuuccgggaccucgggcgcgugauggugauggucggcgccaccaugaccgacgacaucggcaugggggugaccuaccuggcccugcucgccgccuucaaggugcgccccacguucgcggccggccugcugcuccggaagcugaccagcaaggagcugaugauggccaccaucgggaucgcccuccugucccagagcaccauccccgagacgauccuggagcucaccgacgcccuggcgcugggcaugaugguccucaagaucgugcgcaacauggagaaguaccagcuggccgugaccaucauggccaucuccugcgucccgaacgccgugauccugcagaacgccuggaaggugagcugcaccauccucgcggccgucuccgugagcccccugcugcucacguccagccagcagaaggccgacuggaucccccuggcccugaccaucaagggccucaaccccaccgcgaucuuccugaccacgcugucccggaccagcaagaagcgcuccuggccgcucaacgaggccgucauggccguggggauggugagcauccuggccuccagccugcucaagaacgacauccccaugaccggcccccuggucgccgggggccugcucaccgugugcuacgugcugacggggcggagcgcggaccuggagcucgagcgcgccgccgacgucaagugggaggaccaggccgagaucuccggcagcucccccauccugagcaucaccaucuccgaggacggcagcauguccaucaagaacgaggaggaggagcacacccugaccauccucauccggacggggcugcuggugaucagcggcguguucccggucuccauccccaucaccgccgcggccugguaccucugggaggugaagaagcagcgcgccggggugcugugggacguccccagcccgccgcccgugggcaaggccgagcuggaggacggggccuaccggaucaagcagcgcggcaucuucggcuacucccagaucggggcgggcguguacaaggaggggaccuuccacaccauguggcacgucacccggggcgccgugcucaugcaccgcgggaagcggaucgagcccagcugggccgacgugaagaaggaccugaucuccuacggcggcggguggaagcuggagggcgaguggaaggagggggaggagguccaggugcucgcccuggagcccggcaagaacccccgcgccgugcagacgaagcccgggcuguucaagaccaacaccggcaccaucggcgcggucagccucgacuucucccccgggacgagcggcucccccaucguggaccggaaggggaagguggucggccuguacggcaacgggguggugacccgcagcggcgccuacgucuccgccaucgcccagaccgagaaguccaucgaggacaaccccgagaucgaggacgacaucuuccggaagaagcgccugaccaucauggaccuccaccccggggcgggcaagacgaagcgguaccugcccgccaucgugcgcgaggccaucaagcgggggcugcgcacccugauccucgccccgacccgcguggucgccgcggagauggaggaggcccugcggggccugcccauccgcuaccagacccccgccauccgggccgagcacacgggccgcgagaucguggaccucaugugccacgccaccuucaccaugcggcugcugagccccgugcgcgucccgaacuacaaccucaucaucauggacgaggcgcacuucaccgaccccgccuccaucgccgcccggggguacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggucugguucgugccguccaucaaggccggcaacgacaucgcggccugccugcgcaagaacgggaagaaggugauccagcugagccggaagaccuucgacuccgaguacgucaagacccgcgccaacgacugggacuucguggugaccacggacaucagcgagaugggcgccaacuuccgggccgagcgcgucaucgacccccggcgcugcaugaagcccgugauccucaccgacggggaggagcgggugauccuggcgggccccaugccggucacccacuccagcgccgcccagcgccgcgggcggaucggccgcaaccccaagaacgagaacgaccaguacaucuacaugggcgagccccuggagaacgacgaggacugcgcccacuggaaggaggccaagaugcuccuggacaacaucaacacccccgaggggaucaucccguccauguucgagcccgagcgggagaagguggacgcgaucgacggcgaguaccgccugcgcggggaggcccgcaagacguucguggaccucaugcggcgcggcgaccugcccgucuggcuggccuaccggguggccgccgaggggaucaacuacgcggaccgccgguggugcuucgacggcaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcggggcggaagucccugacccucaaccugaucaccgagaugggccgccugcccacguucaugacccagaaggcccgggacgcccucgacaaccuggccgugcugcacaccgccgaggucgggggccgcgcguacaaccacgcccucagcgagcugcccgagacccuggagacgcuccugcugcucacccugcuggccaccgugaccggcgggaucuuccucuuccugauguccggcaaggggaucggcaagaugacgcuggggaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucggccuggggagcaucaccacccaggagagcgaguccaacauccuggacaucgaccuccgcccggccagcgccuggacgcuguacgccguggccaccaccuucgugacccccaugcugcggcacuccaucgagaacagcuccgucaacgugagccucacggcgaucgccaaccaggccaccgugcugaugggccuggggcgcggcuggccccucuccaagauggacaucggggucccccugcuggccaucggcugcuacagccaggugaacccgaucacccucaccgcggcccugcugcuccugguggcccacuacgccaucaucggccccgggcugcaggccaaggcgacgcgcgaggcccagaagcggaccgccgccggcaucaugaagaaccccaccgucgacgggaucaccgugaucgaccucgagcccaucccguacgaccccaaguucgagaagcagcugggccaggugaugcugcucguccugugcgugacccaggugcugaugaugcgcaccaccugggcccucugcgaggcgcugacccuggccacggggcccaucuccacccucugggagggcaaccccggccgguucuggaacaccaccaucgccgucagcauggccaacaucuuccgcggguccuaccuggccggcgcggggcuccucuucagcaucaugaagaacacgaccaacacccggcgcggcaccggcaacaucggggagacgcugggcgagaaguggaagucccggcugaacgcccucggcaagagcgaguuccagaucuacaagaaguccggcauccaggagguggaccgcacccuggccaaggaggggaucaagcggggcgagaccgaccaccacgccgugagccgcggcuccgcgaagcugcggugguucgucgagcgcaacauggugaccccggaggggaagguggucgaccucggcugcgggcggggcggguggagcuacuacugcggcggccugaagaacgugcgcgaggugaaggggcugacgaagggcgggcccggccacgaggagcccauccccauguccaccuacggguggaaccucguccggcugcagagcggcguggacguguucuucaccccgcccgagaagugcgacacccugcucugcgacaucggcgagagcucccccaaccccacgaucgaggccgggcgcacccugcggguccugaaccucguggagaacuggcugaacaacaacacccaguucugcaucaaggugcugaacccguacaugcccagcgucaucgagaagauggagacccuccagcgcaaguacggcggggcccuggugcggaacccccugucccgcaacagcacccacgagauguacuggguguccaacgccacgggcaacaucgucagcuccgugaacaugaucagccgcaugcugaucaaccgguucaccaugaagcacaagaaggccaccuacgagccggacguggaccucggguccggcacccgcaacaucggcaucgagaacgagauccccaaccuggacaucaucgggaagcggaucgagaagaucaagcaggagcacgagacgagcuggcacuacgaccaggaccaccccuacaagaccugggcguaccacggcuccuacgagaccaagcagaccgggagcgccuccagcauggucaacggcguggugaagcugcucacgaagcccugggacgucgugccgauggugacccagauggccaugaccgacaccacgcccuucggccagcagcgcgucuucaaggagaagguggacacccggacccaggagcccaaggaggggaccaagaagcugaugcgcaucacggccgaguggcuguggaaggagcucggcaagaagaagacgccccggaugugcacccgcgaggaguucacccggaaggugcgcuccaacgccgcgcugggggccaucuucacggacgagaacaaguggaaguccgcccgggaggccgucgaggacucccgcuucugggagcugguggaccgggagcgcaaccuccaccuggagggcaagugcgagaccugcgucuacaacaugauggggaagcgggagaagaagcugggcgaguucggcaaggccaaggggagccgcgcgaucugguacauguggcucggcgcccgguuccuggaguucgaggcccugggguuccucaacgaggaccacugguucucccgcggcaacagccugagcgggguggagggcgagggccugcacaagcucggguacauccugcgggacguguccaagaaggagggcggggccauguacgcggacgacaccgccggcugggacacccgcaucacgcuggaggaccucaagaacgaggagauggucaccaaccacaugaagggggagcacaagaagcuggccgaggccaucuucaagcugaccuaccagaacaagguggugcggguccagcgcccgacgccccggggcacggugauggacaucaucagccggaaggaccagcgcggcuccggccagguggggaccuacgggcucaacaccuucaccaacauggaggcccagcugauccggcagauggagggcgagggcaucuucaagagcauccagcgccugacggucaccgaggagaucgcggugcagaacuggcucgcccggguggggcgcgagcggcugucccgcauggccaucagcggcgacgacugcgucgugaagccccuggacgaccgguucgccuccgcccucaccgcgcugaacgacauggggaaggugcgcaaggacauccagcagugggagcccagccggggcuggaacgacuggacccaggucccguucugcucccaccacuuccacgagcuggugaugaaggacgggcgcgugcucgucgugcccugccggaaccaggacgagcugaucggccgcgcccggaucagccagggcgccggguggucccugaaggagacggccugccucggcaagagcuacgcccagauguggacccugauguacuuccaccgccgggaccugcgccucgcggccaacgccaucugcuccgccgugcccagccacuggguccccaccucccggaccaccuggagcauccacgccaagcacgaguggaugacgaccgaggacaugcuggcgguguggaaccgcguguggauccaggagaacccguggauggaggacaagacccccgucgaguccugggaggaggugcccuaccuggggaagcgcgaggaccaguggugcggcagccucaucgggcugaccagccgggccacgugggccaagaacauccagaccgccaucaaccaggugcgcucccugaucggcaacgaggaguacaccgacuacaugcccagcaugaagcgguuccgcaaggaggaggaggaggcgggcguccucugguga

SEQ ID NO: 9429 - RNA, 9876 nt, Artificial Sequence
  derived and/or modified CDS sequence (opt1) from DENV-2__EU687231__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcggaccgccgccgggaucaugaagaaccccaccgucgacggcaucaccgugaucgaccucgagcccaucccguacgaccccaaguucgagaagcagcugggccaggugaugcugcucguccugugcgugacccaggugcugaugaugcgcaccaccugggcccucugcgaggcgcugacccuggccacgggccccaucagcacccucugggaggggaaccccggccgguucuggaacaccaccaucgccgucuccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcagagcgggguggacguguucuucaccccgcccgagaagugcgacacccugcucugcgacaucggcgaguccagccccaaccccacgaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccacggggaacaucgucuccagcgugaacaugaucucccgcaugcugaucaaccgguucaccaugaagcacaagaaggccaccuacgagccggacguggaccucggcagcgggacccgcaacaucggcaucgagaacgagauccccaaccuggacaucaucggcaagcggaucgagaacaucaagcaggagcacgagacguccuggcacuacgaccaggaccaccccuacaagaccugggcguaccacgggagcuacgagaccaagcagaccggcuccgccagcuccauggucaacgggguggugaagcugcucacgaagcccugggacgucgugccgauggugacccagauggccaugaccgacaccacgcccuucggccagcagcgcgucuucaaggagaagguggacacccggacccaggagcccaaggagggcaccaagaagcugaugcgcaucacggccgaguggcuguggaaggagcucgggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggggccauguacgcggacgacaccgccgggugggacacccgcaucacgcuggaggaccucaagaacgaggagauggucaccaaccacaugaagggcgagcacaagaagcuggccgaggccaucuucaagcugaccuaccagaacaagguggugcggguccagcgcccgacgccccgggggacggugauggacaucaucucccggaaggaccagcgcggcagcggccagguggggaccuacggccucaacaccuucaccaacauggaggcccagcugauccggcagauggagggggagggcaucuucaaguccauccagcgccugacggucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccgugcccucccacuggguccccaccagccggaccaccugguccauccacgccaagcacgaguggaugacgaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9430 - RNA, 9876 nt, Artificial Sequence
  derived and/or modified CDS sequence (opt1) from DENV-2__EU687199__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaugauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccgcccggccagcgccuggacccuguacgccguggccaccaccuucgugacgcccaugcugcggcacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucuccacccucugggaggggaaccccggccgguucuggaacaccacgaucgccgucagcauggccaacaucuuccgcggcuccuaccuggccggggcgggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacauggugacgccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucaccccgcccgagaagugcgacacgcugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacgcacgagauguacugggucuccaacgccaccgggaacaucgugagcuccgugaacaugaucagccgcaugcugaucaaccgguucaccaugaagcacaagaaggccaccuacgagccggacgucgaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucagccggaaggaccagcgcggcuccggccaggucgggaccuacggccucaacaccuucacgaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucaccgcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccugggcaagcgcgaggaccaguggugcgggagccucaucggccugacgagccgggccaccugggccaagaacauccagaccgccaucaaccagguccgcucccugaucgggaacgaggaguacaccgacuacaugcccagcaugaagcgguuccgcaaggaggaggaggaggcgggcgugcucugguga

SEQ ID NO: 9431 - RNA, 9876 nt, Artificial Sequence
  derived and/or modified CDS sequence (opt1) from DENV-2__EU687235__SS-prME
accgccggggugaucaucaugcugauccccaccgccauggcguuccaccucaccacccggaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgacucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccccugguggggaaggccgagcucgaggacggcgccuaccggaucaagcagcgcgggaucuucggcuacucccagaucggcgcggggguguacaaggagggcaccuuccacaccauguggcacgucacgcgcggggccgugcugaugcaccgcggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgccgugcagaccaagcccggccucuucaagaccaacaccgggacgaucggcgcggucagccuggacuucucccccggcaccagcgggucccccaucguggaccggaagggcaagguggucgggcuguacggcaacggcguggugacccgcagcggggccuacgucuccgccaucgcccagaccgagaaguccaucgaggacaacccggagaucgaggacgacaucuuccggaagaagcgccucacgaucauggaccugcaccccggcgcggggaagaccaagcgguaccugcccgccaucgugcgcgaggccaucaagcggggccugcgcacccucauccuggcccccacccgcguggucgccgcggagauggaggaggcccugcgggggcucccgauccgcuaccagacgcccgccauccgggccgagcacaccggccgcgagaucguggaccugaugugccacgccaccuucaccaugcggcugcucagccccgugcgcguccccaacuacaaccugaucaucauggacgaggcgcacuucacggacccggccuccaucgccgcccggggcuacaucagcacccgcguggagaugggggaggccgcgggcaucuucaugaccgccacgccgcccgggucccgggaccccuucccgcagagcaacgcccccaucauggacgaggagcgcgagauccccgagcgguccuggaacagcggccacgagugggugacggacuucaaggggaagaccgucugguucgugcccuccaucaaggccggcaacgacaucgcggccugccugcgcaagaacggcaagaaggugauccagcucagccggaagaccuucgacuccgaguacgucaagacccgcgccaacgacugggacuucguggugacgaccgacaucagcgagaugggggccaacuuccgggccgagcgcgucaucgacccgcggcgcugcaugaagcccgugauccugaccgacggcgaggagcgggugauccuggcggggcccaugcccgucacccacuccagcgccgcccagcgccgcggccggaucgggcgcaacccgaagaacgagaacgaccaguacaucuacaugggcgagccccucgagaacgacgaggacugcgcccacuggaaggaggccaagaugcugcuggacaacaucaacacgcccgagggcaucauccccuccauguucgagccggagcgggagaagguggacgcgaucgacggggaguaccgccuccggggcgaggcccgcaagaccuucguggaccugaugcggcgcggggaccugcccgucuggcucgccuaccggguggccgccgagggcaucaacuacgcggaccgccgguggugcuucgacgggaucaagaacaaccagauccuggaggagaacguggaggucgagaucuggaccaaggagggcgagcgcaagaagcugaagccccgguggcucgacgcccgcaucuacagcgacccgcuggcccugaaggaguucaaggaguucgccgcgggccggaagucccucacccugaaccugaucacggagauggggcgccuccccaccuucaugacccagaaggcccgggacgcccuggacaaccuggccgugcuccacaccgccgaggucggcgggcgcgcguacaaccacgcccugagcgagcugcccgagacgcucgagacccugcugcuccugacccugcucgccaccgugacgggcggcaucuuccuguuccugauguccgggaagggcaucgggaagaugacccucggcaugugcugcaucaucaccgccagcauccugcugugguacgcccagauccagccccacuggaucgcggccuccaucauccucgaguucuuccugaucgugcugcucaucccggagcccgagaagcagcggacgccccaggacaaccagcugaccuacgucgugaucgccauccugacgguggucgccgccaccauggcgaacgagaugggguuccucgagaagaccaagaaggaccugggccugggcagcaucaccacgcaggagagcgaguccaacauccucgacaucgaccugcgccccgccagcgccuggacccuguacgccguggccaccaccuucgugacgccgaugcuccggcacuccaucgagaacagcuccgucaacgugagccugaccgcgaucgccaaccaggccaccgugcugauggggcucggccgcggguggccccuguccaagauggacaucggcgucccccugcucgccaucgggugcuacagccaggugaaccccaucacccugacggcggcccugcuccugcugguggcccacuacgccaucaucggcccgggccuccaggccaaggcgacccgcgaggcccagaagcggaccgccgccgggaucaugaagaaccccaccgucgacggcaucacggugaucgaccuggagcccauccccuacgacccgaaguucgagaagcagcugggccaggugaugcuccugguccugugcgugacccaggugcucaugaugcgcaccaccugggcccugugcgaggcgcugacgcucgccaccggccccaucuccacccugugggaggggaaccccggccgguucuggaacaccacgaucgccgucagcauggccaacaucuuccgcggcuccuaccuggccggggcgggccuccuguucagcaucaugaagaacaccaccaacacccggcgcgggacgggcaacaucggcgagacccugggggagaaguggaagucccggcucaacgcccugggcaagagcgaguuccagaucuacaagaaguccgggauccaggagguggaccgcacccuggccaaggagggcaucaagcgcggggagaccgaccaccacgccgugagccgcggcuccgcgaagcuccggugguucgucgagcgcaacauggugacgcccgagggcaagguggucgaccuggggugcggccgcggcggguggagcuacuacugcggcgggcugaagaacgugcgcgaggugaaggggcucaccaagggcgggccggggcacgaggagcccauccccauguccaccuacggcuggaaccugguccggcugcagagcgggguggacguguucuucacgccgcccgagaagugcgacacgcuccugugcgacaucggcgagagcucccccaaccccaccaucgaggccggccgcacccugcggguccucaaccugguggagaacuggcugaacaacaacacccaguucugcgugaagguccucaaccccuacaugcccagcgugaucgagaagauggagacccugcagcgcaaguacgggggcgcccuggugcggaacccccugucccgcaacagcacgcacgagauguacugggucuccaacgccaccgggaacaucgugagcuccgugaacaugaucagccgcaugcucaucaaccgguucaccaugaagcacaagaaggccaccuacgagcccgacgucgaccugggcuccgggacgcgcaacaucggcaucgagaacgagaucccgaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcuccugaccaagcccugggacguggugcccauggucacccagauggccaugaccgacacgaccccguucggccagcagcgcguguucaaggagaagguggacacccggacccaggagcccaaggagggcacgaagaagcugaugcgcaucaccgccgaguggcucuggaaggagcuggggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcucgucgaccgggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucucccgcgggaacagccugagcggcguggagggggagggccuccacaagcugggcuacauccugcgggacgucuccaagaaggagggcggggccauguacgcggacgacaccgccgggugggacacgcgcaucacccucgaggaccugaagaacgaggagauggugaccaaccacaugaagggcgagcacaagaagcuggccgaggccaucuucaagcucaccuaccagaacaaggugguccgggugcagcgccccacgccgcgcgggaccgugauggacaucaucagccggaaggaccagcgcggcuccggccaggucgggaccuacggccugaacaccuucacgaacauggaggcccagcugauccggcagauggagggggagggcaucuucaagagcauccagcgccucaccgugaccgaggagaucgcggugcagaacuggcuggcccgggucggccgcgagcggcugucccgcauggccaucagcggggacgacugcguggugaagccccucgacgaccgguucgccuccgcccugaccgcgcugaacgacaugggcaagguccgcaaggacauccagcagugggagcccagccggggguggaacgacuggacccaggugcccuucugcucccaccacuuccacgagcucgugaugaaggacggccgcguccugguggugccgugccggaaccaggacgagcugaucgggcgcgcccggaucagccagggcgccggcuggucccucaaggagaccgccugccugggcaagagcuacgcccagauguggacccugauguacuuccaccgccgggaccuccgccuggcggccaacgccaucugcuccgccguccccagccacugggugcccaccucccggaccacguggagcauccacgccaagcacgaguggaugaccaccgaggacaugcuggcgguguggaaccgcgucuggauccaggagaaccccuggauggaggacaagaccccgguggaguccugggaggaggugcccuaccucggcaagcgcgaggaccaguggugcgggagccugaucggccugacgagccgggccaccugggccaagaacauccagaccgccaucaaccagguccgcucccucaucgggaacgaggaguacaccgacuacaugcccagcaugaagcgguuccgcaaggaggaggaggaggcgggcgugcugugguga

SEQ ID NO: 9432 - RNA, 9876 nt, Artificial Sequence
  derived and/or modified CDS sequence (opt1) from DENV-2__EU687236__SS-prME
accgccggggugaucaucaugcugauccccaccgccauggcguuccaccucaccacccgcaacggggagccccacaugaucgucgggcggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagaaggccgccgacgucaagugggaggaccaggccgagaucuccgggagcucccccauccugagcaucaccaucuccgaggacggcagcauguccaucaagaacgaggaggaggagcacacccugacgauccucauccgcaccggccugcuggugaucagcgggguguucccggucuccauccccaucaccgccgcggccugguaccucugggaggugaagaagcagcgggccggcgugcugugggacguccccagcccgccgcccguggggaaggccgagcuggaggacggcgccuaccgcaucaagcagcgggggaucuucggcuacucccagaucggcgcggggguguacaaggagggcaccuuccacaccauguggcacgucacgcgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggccuguucaagaccaacaccgggacgaucggcgcggucagccucgacuucucccccggcaccagcgggucccccaucguggaccgcaagggcaagguggucgggcuguacggcaacggcguggugacccggagcggggccuacgucuccgccaucgcccagaccgagaaguccaucgaggacaaccccgagaucgaggacgacaucuuccgcaagaagcggcugacgaucauggaccuccaccccggcgcggggaagaccaagcgcuaccugcccgccaucgugcgggaggccaucaagcgcggccugcggacccugauccucgccccgacccgcguggucgccgcggagauggaggaggcccugcgcgggcugcccauccgguaccagacgcccgccauccgcgccgagcacaccggccgggagaucguggaccucaugugccacgccaccuucaccaugcgccugcugagccccgugcgggucccgaacuacaaccucaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgcggccugccugcggaagaacggcaagaaggugauccagcugagccgcaagaccuucgacuccgaguacgucaagacccgggccaacgacugggacuucguggugacgaccgacaucagcgagaugggggccaacuuccgcgccgagcgggucaucgacccccgccggugcaugaagcccgugauccucaccgacggcgaggagcgcgugauccuggcggggcccaugccggucacccacuccagcgccgcccagcggcgcggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgcgagaagguggacgcgaucgacggggaguaccggcugcgcggcgaggcccggaagaccuucguggaccucaugcgccgcggggaccugcccgucuggcuggccuaccgcguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaaggcccgcgacgcccucgacaaccuggccgugcugcacaccgccgaggucggcgggcgggcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcgcacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccggccggccagcgccuggacccuguacgccguggccaccaccuucgugacgcccaugcugcgccacuccaucgagaacagcuccgucaacgugagccucaccgcgaucgccaaccaggccaccgugcugauggggcugggccggggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgcgaggcccagaagcgcaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcggaccaccugggcccucugcgaggcgcugacgcuggccaccggccccaucuccacccucugggaggggaaccccggccgcuucuggaacaccacgaucgccgucagcauggccaacaucuuccggggcuccuaccuggccggggcgggccuccucuucagcaucaugaagaacaccaccaacacccgccgggggacgggcaacaucggcgagacccugggggagaaguggaagucccgccugaacgcccucggcaagagcgaguuccagaucuacaagaaguccgggauccaggagguggaccggacccuggccaaggagggcaucaagcgcggggagaccgaccaccacgccgugagccggggcuccgcgaagcugcgcugguucgucgagcggaacauggugacgccggagggcaagguggucgaccucgggugcggccgcgggggcuggagcuacuacugcgggggccugaagaacgugcgggaggugaagggccugaccaagggcgggcccgggcacgaggagcccauccccauguccaccuacggcuggaaccucguccgccugcagagcgggguggacguguucuucaccccgcccgagaagugcgacacgcugcucugcgacaucggcgagagcucccccaaccccaccaucgaggccggccggacccugcgcguccugaaccucguggagaacuggcugaacaacaacacccaguucugcgugaagguccugaacccguacaugcccagcgugaucgagaagauggagacccuccagcggaaguacgggggcgcccuggugcgcaacccccugucccggaacagcacgcacgagauguacugggucuccaacgccaccgggaacaucgugagcuccgugaacaugaucagccgcaugcugaucaaccgcuucaccaugaagcacaagaaggccaccuacgagccggacgucgaccucggcuccgggacgcggaacaucggcaucgagaacgagauccccaaccuggacaucaucggcaagcgcaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcggguguucaaggagaagguggacacccgcacccaggagcccaaggagggcacgaagaagcugaugcggaucaccgccgaguggcuguggaaggagcucgggaagaagaagacgccccgcaugugcacccgggaggaguucacgaagaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgggggaccgugauggacaucaucagccgcaaggaccagcgcggcuccggccaggucgggaccuacggccucaacaccuucacgaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucaccgcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccugggcaagcgggaggaccaguggugcgggagccucaucggccugacgagccgcgccaccugggccaagaacauccagaccgccaucaaccagguccgcucccugaucgggaacgaggaguacaccgacuacaugcccagcaugaagcgguuccgcaaggaggaggaggaggcgggcgugcucugguga

SEQ ID NO: 9433 - RNA, 9876 nt, Artificial Sequence
  derived and/or modified CDS sequence (opt1) from DENV-2__EU687237__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccgcccggccagcgccuggacccuguacgccguggccaccaccuucgugacgcccaugcugcggcacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucuccacccucugggaggggaaccccggccgguucuggaacaccacgaucgccgucagcauggccaacaucuuccgcggcuccuaccuggccggggcgggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacauggugacgccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucaccccgcccgagaagugcgacacgcugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacgcacgagauguacugggucuccaacgccaccgggaacaucgugagcuccgugaacaugaucagccgcaugcugaucaaccgguucaccaugaagcacaagaaggccaccuacgagccggacgucgaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucagccggaaggaccagcgcggcuccggccaggucgggaccuacggccucaacaccuucacgaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucaccgcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccugggcaagcgcgaggaccaguggugcgggagccucaucggccugacgagccgggccaccugggccaagaacauccagaccgccaucaaccagguccgcucccugaucgggaacgaggaguacaccgacuacaugcccagcaugaagcgguuccgcaaggaggaggaggaggcgggcgugcucugguga

SEQ ID NO: 9434 - RNA, 9876 nt, Artificial Sequence
  derived and/or modified CDS sequence (opt1) from DENV-2__EU687238__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugacgaucaccuggaucgggaugaacagccgcuccaccagccuguccgucagccucgugcuggugggcgucgugacccuguaccucggggugaugguccaggccgacacgggcugcgugguguccuggaagaacaaggagcugaagugcggcagcgggaucuucaucaccgacaacguccacaccuggaccgagcaguacaaguuccagcccgagucccccagcaagcuggcgagcgccauccagaaggcccacgaggagggcaucugcgggauccgguccgugacgcgccucgagaaccugauguggaagcagaucacccccgagcugaaccacauccucagcgagaacgaggugaagcugaccaucaugaccggcgacaucaaggggaucaugcaggccggcaagcggucccugcgcccgcagcccacggagcucaaguacagcuggaagaccuggggcaaggccaagaugcuguccaccgagagccacaaccagaccuuccugaucgacgggcccgagacggcggagugcccgaacaccaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacgcagaccgccgggcccuggcaccugggcaagcuggagauggacuucgacuucugcgaggggaccaccgucguggugacggaggacugcggcaaccggggccccagccuccgcaccaccaccgcgagcgggaagcugaucacggaguggugcugccgguccugcacccugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcacgaagcacgccauccuccugguggcggugagcuucgucacccugaucaccgggaacauguccuuccgggaccucggccgcgugauggugauggucggggccaccaugacggacgacaucggcaugggcgugaccuaccuggcccugcucgccgccuucaaggugcgccccaccuucgcggccgggcugcugcuccggaagcugaccagcaaggagcugaugauggccacgaucggcaucgcccuccugucccagagcaccauccccgagaccauccuggagcucaccgacgcccuggcgcuggggaugaugguccucaagaucgugcgcaacauggagaaguaccagcuggccgugacgaucauggccaucuccugcgucccgaacgccgugauccugcagaacgccuggaaggugagcugcaccauccucgcggccgucuccgugagcccccugcugcucaccuccagccagcagaaggccgacuggaucccccuggcccugaccaucaagggccucaaccccacggcgaucuuccugaccacccugucccggaccagcaagaagcgcuccuggccgcucaacgaggccgucauggccgugggcauggugagcauccuggccuccagccugcucaagaacgacauccccaugacggggccccuggucgccggcgggcugcucaccgugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacgcugaccauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacacgauguggcacgucacccgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacacggggaccaucggcgcggucagccucgacuucucccccggcaccagcgggucccccaucguggaccggaagggcaagguggucgggcuguacggcaacggcguggugacccgcagcggggccuacgucuccgccaucgcccagacggagaaguccaucgaggacaaccccgagaucgaggacgacaucuuccggaagaagcgccugaccaucauggaccuccaccccggcgcggggaagaccaagcgguaccugcccgccaucgugcgcgaggccaucaagcggggccugcgcacccugauccucgccccgacgcgcguggucgccgcggagauggaggaggcccugcgggggcugcccauccgcuaccagacccccgccauccgggccgagcacaccggccgcgagaucguggaccucaugugccacgccaccuucacgaugcggcugcugagccccgugcgcgucccgaacuacaaccucaucaucauggacgaggcgcacuucaccgaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgucugguucgugccguccaucaaggccggcaacgacaucgcggccugccugcgcaagaacggcaagaaggugauccagcugagccggaagaccuucgacuccgaguacgucaagacgcgcgccaacgacugggacuucguggugaccaccgacaucagcgagaugggggccaacuuccgggccgagcgcgucaucgacccccggcgcugcaugaagcccgugauccucaccgacggcgaggagcgggugauccuggcggggcccaugccggucacgcacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacgcucaaccugaucaccgagauggggcgccugcccaccuucaugacccagaaggcccgggacgcccucgacaaccuggccgugcugcacacggccgaggucggcgggcgcgcguacaaccacgcccucagcgagcugcccgagacccuggagacccuccugcugcucacccugcuggccacggugaccggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucacguacgucgugaucgccauccugaccguggucgccgccaccauggcgaacgagaugggguuccuggagaagaccaagaaggaccucggccugggcagcaucacgacccaggagagcgaguccaacauccuggacaucgaccuccgcccggccagcgccuggacccuguacgccguggccaccacguucgugacccccaugcugcggcacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacgcucaccgcggcccugcugcuccugguggcccacuacgccaucaucggccccggccugcaggccaaggcgacccgcgaggcccagaagcggaccgccgccgggaucaugaagaaccccacggucgacggcaucaccgugaucgaccucgagcccaucccguacgaccccaaguucgagaagcagcugggccaggugaugcugcucguccugugcgugacccaggugcugaugaugcgcaccacgugggcccucugcgaggcgcugacccuggccaccggccccaucuccacccucugggaggggaaccccggccgguucuggaacacgaccaucgccgucagcauggccaacaucuuccgcggcuccuaccuggccggggcgggccuccucuucagcaucaugaagaacaccaccaacacgcggcgcgggaccggcaacaucggcgagacccugggggagaaguggaagucccggcugaacgcccucggcaagagcgaguuccagaucuacaagaaguccgggauccaggagguggaccgcacccuggccaaggagggcaucaagcgcggggagacggaccaccacgccgugagccgcggcuccgcgaagcugcggugguucgucgagcgcaacauggugaccccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacgcuccagcgcaaguacgggggcgcccuggugcggaacccccugucccgcaacagcacccacgagauguacugggucuccaacgccaccgggaacaucgugagcuccgugaacaugaucagccgcaugcugaucaaccgguucaccaugaagcacaagaaggccacguacgagccggacgucgaccucggcuccgggacccgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggugaacgggguggucaagcugcucaccaagcccugggacguggugccgauggucacccagauggccaugacggacaccacccccuucggccagcagcgcguguucaaggagaagguggacacccggacgcaggagcccaaggagggcaccaagaagcugaugcgcaucaccgccgaguggcuguggaaggagcucgggaagaagaagacgccccggaugugcacgcgcgaggaguucacccggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacacggccgggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccgggggaccgugauggacaucaucagccggaaggaccagcgcggcuccggccaggucgggaccuacggccucaacacguucaccaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucacggcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccguccccagccacugggugcccaccucccggacgaccuggagcauccacgccaagcacgaguggaugaccaccgaggacaugcuggcgguguggaaccgcgucuggauccaggagaacccguggauggaggacaagacgcccguggaguccugggaggaggugcccuaccugggcaagcgcgaggaccaguggugcgggagccucaucggccugaccagccgggccaccugggccaagaacauccagaccgccaucaaccagguccgcucccugaucgggaacgaggaguacacggacuacaugcccagcaugaagcgguuccgcaaggaggaggaggaggcgggcgugcucugguga

SEQ ID NO: 9435 - RNA, 9876 nt, Artificial Sequence
  derived and/or modified CDS sequence (opt1) from DENV-2__EU687240__SS-prME
accgugggcgucaucaucaugcugauccccaccgccauggccuuccaccucaccacccgcaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgccauccuggcguacaccaucgggaccacgcacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacaccaucgucaucacgccccacagcggggaggagcacgcggugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgccaagaagcaggacgucgugguccuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccacgaugcgcggcgcgaagcggauggccauccugggggacaccgccugggacuucggcagccucgggggcgucuucaccuccaucgggaaggcccugcaccagguguucggcgccaucuacggcgcggccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcuccgggaucuucaucaccgacaacgugcacacguggaccgagcaguacaaguuccagcccgagagccccagcaagcuggccuccgcgauccagaaggcccacgaggagggcaucugcgggauccggagcgugacccgccucgagaaccugauguggaagcagaucacccccgagcugaaccacauccucuccgagaacgaggccaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugaccauccucauccggacgggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucucccucgacuucagccccggcacguccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcguggucgccgcggagauggaggaggcccugcgggggcugcccauccgcuaccagacccccgccauccgggccgagcacacgggccgcgagaucguggaccucaugugccacgccaccuucaccaugcggcugcugucccccgugcgcgucccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugaccacggacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggucggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgugacccccaugcugcggcacagcaucgagaacuccagcgucaacgugucccucacggcgaucgccaaccaggccaccgugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacgcgcgaggcccagaagcggaccgccgccgggaucaugaagaaccccaccgucgacggcaucaccgugaucgaccucgagcccaucccguacgaccccaaguucgagaagcagcuggggcaggucaugcugcucguccugugcgugacccaggugcugaugaugcgcaccaccugggcccucugcgaggcgcugacccuggccacgggccccaucagcacccucugggaggggaaccccggccgguucuggaacaccaccaucgccgucuccauggccaacaucuuccgcggcagcuaccuggccggggcgggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcagagcgggguggacguguucuucaccccgcccgagaagugcgacacccugcucugcgacaucggcgaguccagccccaaccccacgaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccacggggaacaucgucuccagcgugaacaugaucucccgcaugcugaucaaccgguucaccaugaagcacaagaaggccaccuacgagccggacguggaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugaagcugcucacgaagcccugggacgucgugccgauggugacccagauggccaugaccgacaccacgcccuucggccagcagcgcgucuucaaggagaagguggacacccggacccaggagcccaaggagggcaccaagaagcugaugcgcaucacggccgaguggcuguggaaggagcucgggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgugagcaagaaggagggcggcgccauguacgcggacgacaccgccgggugggacacccgcaucacgcuggaggaccucaagaacgaggagauggucaccaaccacaugaagggcgagcacaagaagcuggccgaggccaucuucaagcugaccuaccagaacaagguggugcggguccagcgcccgacgccccgggggacggugauggacaucaucucccggaaggaccagcgcggcagcggccagguggggaccuacggccucaacaccuucaccaacauggaggcccagcugauccggcagauggagggggagggcaucuucaaguccauccagcgccugacggucaccgaggagaucgcggugcagaacuggcucgcccgggugggccgcgagcggcugagccgcauggccaucuccggggacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgccggcuggagccugaaggagacggccugccucgggaaguccuacgcccagauguggacccugauguacuuccaccgccgggaccugcgccucgcggccaacgccaucugcagcgccgugcccucccacuggguccccaccagccggaccaccugguccauccacgccaagcacgaguggaugacgaccgaggacaugcuggcgguguggaaccgcguguggauccaggagaacccguggauggaggacaagacccccgucgagagcugggaggaggugcccuaccugggcaagcgcgaggaccaguggugcgggagccucaucggccugaccucccgggccacgugggccaagaacauccagaccgccaucaaccaggugcgcagccugaucgggaacgaggaguacaccgacuacaugcccuccaugaagcgguuccgcaaggaggaggaggaggcgggcguccucugguga

SEQ ID NO: 9436 - RNA, 9876 nt, Artificial Sequence
  derived and/or modified CDS sequence (opt1) from DENV-2__EU687241__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacagcaucgggaccacccacuuccagcgggcccucaucuucauccugcugacggccguggcgcccuccaugaccaugcgcugcaucggcaucagcaaccgggacuucguggagggcgucuccgggggcagcuggguggacaucgugcucgagcacggguccugcgucaccaccauggccaagaacaagcccacgcuggacuucgagcugaccaagaccgaggccaagcagcccgccacccuccgcaaguacugcaucgaggccaagcugacgaacaccaccaccgagagccggugcccgacgcagggcgagcccucccugaacgaggagcaggacaagcgcuucaucugcaagcacagcaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacuccggggaggagcacgccgucggcaacgacaccgggaagcacggcaaggagaucaagaucaccccgcagagcuccaucaccgaggccgagcucaccggguacggcacggugaccauggagugcagcccccgcaccggccuggacuucaacgagauggugcugcuccagauggaggacaaggccuggcugguccaccggcagugguuccuggaccucccccugcccuggcugccgggggccgacacccagggcuccaacuggauccagaaggagacgcucgugaccuucaagaacccccacgcgaagaagcaggacguggucgugcuggggagccaggagggcgccaugcacaccgcccugaccggggccacggagauccagaugagcuccggcaaccuccuguucaccggccaccugaagugccgccuccggauggacaagcugcagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucauggaccucgagaagcggcacguccuggggcgccugaucaccgugaacccgaucgugaccgagaaggacucccccgucaacaucgaggcggagccgcccuucggcgacagcuacaucaucaucgggguggagccgggccagcucaagcugaacugguucaagaagggguccagcaucggccagauguucgagaccacgaugcgcggcgccaagcggauggccauccugggggacaccgccugggacuucggcucccucgggggcguguucaccagcaucgggaaggcccugcaccaggucuucggcgcgaucuacggcgccgccuucuccggggugagcuggaccaugaagauccugaucggcgugaucaucacguggaucgggaugaacucccgcagcaccucccugagcgucucccucgugcuggugggcgucgugacccuguaccucggggugaugguccaggccgacaccggcugcguggugagcuggaagaacaaggagcugaagugcggcuccgggaucuucaucacggacaacguccacaccuggaccgagcaguacaaguuccagcccgagagccccagcaagcuggcguccgccauccagaaggcccacgaggagggcaucugcgggauccggagcgugacccgccucgagaaccugauguggaagcagaucacgcccgagcugaaccacauccucuccgagaacgaggugaagcugaccaucaugaccggcgacaucaaggggaucaugcaggccggcaagcggagccugcgcccgcagcccaccgagcucaaguacuccuggaagacguggggcaaggccaagaugcugagcaccgagucccacaaccagaccuuccugaucgacgggcccgagaccgcggagugcccgaacacgaaccgggccuggaacagccucgaggucgaggacuacggcuucgggguguucuccaccaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggucaacucccucgugaccgccgggcacggccagaucgacaacuucagccugggcgugcuggggauggcccucuuccuggaggagaugcugcggacccgcgucggcaccaagcacgccauccuccugguggcgguguccuucgucacgcugaucaccgggaacaugagcuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccuccaaggagcugaugauggccaccaucggcaucgcccuccugagccaguccacgauccccgagaccauccuggagcucaccgacgcccuggcgcuggggaugaugguccucaagaucgugcgcaccauggagaaguaccagcuggccgugacgaucauggccaucagcugcgucccgaacgccgugauccugcagaacgccuggaagguguccugcaccauccucgcggccgucagcgugagcccccugcugcucaccagcucccagcagaaggccgacuggaucccccuggcccugaccaucaagggccucaaccccacggcgaucuuccugaccacccugagccggaccuccaagaagcgcagcuggccgcucaacgaggccgucauggccgugggcaugguguccauccuggccagcagccugcucaagaacgacauccccaugacggggccccuggucgccggcgggcugcucaccgugugcuacgugcugaccggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacgcugaccauccucauccggaccggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacacgauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagaccaagcccggccuguucaagaccaacacggggaccaucggcgcggucucccucgacuucagccccggcaccuccgggagccccaucguggaccggaagggcaagguggucgggcuguacggcaacggcguggugacccgcuccggggccuacgucagcgccaucgcccagacggagaaguccaucgaggacaaccccgagaucgaggacgacaucuuccggaagaagcgccugaccaucauggaccuccaccccggcgcggggaagaccaagcgguaccugcccgccaucgugcgcgaggccaucaagcggggccugcgcacccugauccucgccccgacgcgcguggucgccgcggagauggaggaggcccugcgggggcugcccauccgcuaccagacccccgccauccgggccgagcacaccggccgcgagaucguggaccucaugugccacgccaccuucacgaugcggcugcugucccccgugcgcgucccgaacuacaaccucaucaucauggacgaggcgcacuucaccgaccccgccagcaucgccgcccggggcuacaucuccacccgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggccggcaacgacaucgcggccugccugcgcaagaacggcaagaaggugauccagcugucccggaagaccuucgacagcgaguacgucaagacgcgcgccaacgacugggacuucguggugaccaccgacaucuccgagaugggggccaacuuccgggccgagcgcgucaucgacccccggcgcugcaugaagcccgugauccucaccgacggcgaggagcgggugauccuggcggggcccaugccggucacgcacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccgcaagagccugacgcucaaccugaucaccgagauggggcgccugcccaccuucaugacccagaaggcccgggacgcccucgacaaccuggccgugcugcacacggccgaggucggcgggcgcgcguacaaccacgcccucuccgagcugcccgagacccuggagacccuccugcugcucacccugcuggccacggugaccggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacgucgugaucgccauccugaccguggucgccgccaccauggcgaacgagaugggguuccuggagaagaccaagaaggaccucggccugggcagcaucacgacccaggaguccgagagcaacauccuggacaucgaccuccgcccggccuccgccuggacccuguacgccguggccaccacguucgugacccccaugcugcggcacagcaucgagaacuccagcgucaacgugucccucaccgcgaucgccaaccaggccaccgugcugauggggcugggccgcggguggccccucagcaagauggacaucggcgucccccugcuggccaucgggugcuacucccaggugaacccgaucacgcucaccgcggcccugcugcuccugguggcccacuacgccaucaucggccccggccugcaggccaaggcgacccgcgaggcccagaagcggaccgccgccgggaucaugaagaaccccacggucgacggcaucaccgugaucgaccucgagcccaucccguacgaccccaaguucgagaagcagcugggccaggugaugcugcucguccugugcgugacccaggugcugaugaugcgcaccacgugggcccucugcgaggcgcugacccuggccaccggccccaucagcacccucugggaggggaaccccggccgguucuggaacacgaccaucgccgucuccauggccaacaucuuccgcggcagcuaccuggccggggcgggccuccucuucuccaucaugaagaacaccaccaacacgcggcgcgggaccggcaacaucggcgagacccugggggagaaguggaagucccggcugaacgcccucggcaaguccgaguuccagaucuacaagaaguccgggauccaggagguggaccgcacccuggccaaggagggcaucaagcgcggggagacggaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugaccaagggcgggcccgggcacgaggagcccauccccaugagcaccuacggcuggaaccucguccggcugcagagcgggguggacguguucuucacgccgcccgagaagugcgacacccugcucugcgacaucggcgaguccagccccaaccccaccaucgaggccggccgcacccugcggguccugaaccucguggagaacuggcugaacaacaacacccaguucugcgugaagguccugaacccguacaugcccuccgugaucgagaagauggagacgcuccagcgcaaguacgggggcgcccuggugcggaacccccugagccgcaacuccacccacgagauguacugggucagcaacgccaccgggaacaucguguccagcgugaacaugaucucccgcaugcugaucaaccgguucaccaugaagcacaagaaggccacguacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagaccugggcguaccacgggagcuacgagacgaagcagaccggcuccgccagcuccauggugaacgggguggucaagcugcucaccaagcccugggacguggugccgauggucacccagauggccaugacggacaccacccccuucggccagcagcgcguguucaaggagaagguggacacccggacgcaggagcccaaggagggcaccaagaagcugaugcgcaucaccgccgaguggcuguggaaggagcucgggaagaagaagacgccccggaugugcacgcgcgaggaguucacccggaagguccgcagcaacgccgcgcugggcgccaucuucaccgacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggggccauguacgcggacgacacggccgggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccgggggaccgugauggacaucaucucccggaaggaccagcgcggcagcggccaggucgugaccuacgggcucaacacguucaccaacauggaggcccagcugauccggcagauggagggcgaggggaucuucaaguccauccagcgccugaccgugaccgaggagaucgcgguccagaacuggcucgcccgggugggccgcgagcggcugagccgcauggccaucuccggcgacgacugcguggucaagccccuggacgaccgguucgccagcgcccucacggcgcugaacgacauggggaaggugcgcaaggacauccagcagugggagcccucccggggcuggaacgacuggacccaggugccguucugcagccaccacuuccacgagcuggucaugaaggacgggcgcgugcucgugguccccugccggaaccaggacgagcugaucggccgcgcccggaucucccagggggccggcuggagccugaaggagaccgccugccucggcaaguccuacgcccagauguggacccugauguacuuccaccgccgggaccugcgccucgcggccaacgccaucugcagcgccgugcccucccacugggugcccaccagccggacgaccugguccauccacgccaagcacgaguggaugaccaccgaggacaugcuggcggucuggaaccgcguguggauccaggagaacccguggauggaggacaagacgcccguggagagcugggaggagguccccuaccuggggaagcgcgaggaccaguggugcggcagccucaucgggcugaccucccgggccaccugggccaagaacauccagaccgccaucaaccaggugcgcagccugaucggcaacgaggaguacacggacuacaugcccuccaugaagcgguuccgcaaggaggaggaggaggcgggggugcucugguga

SEQ ID NO: 9437 - RNA, 9876 nt, Artificial Sequence
  derived and/or modified CDS sequence (opt1) from DENV-2__EU687242__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacauccgggggaucaugcaggccggcaagcgcucccugcggccgcagcccaccgagcucaaguacagcuggaagacguggggcaaggccaagaugcuguccaccgagagccacaaccagaccuuccugaucgacgggcccgagaccgcggagugcccgaacacgaaccgcgccuggaacucccucgaggucgaggacuacggcuucgggguguucagcaccaacaucuggcugaagcugcgggagaagcaggacguguucugcgacuccaagcucaugagcgccgccaucaaggacaaccgcgccguccacgcggacaugggcuacuggaucgaguccgcccugaacgacaccuggaagauggagaaggccagcuucaucgagaucaaguccugcuacuggcccaagagccacacccugugguccaacggcgugcucgagagcgagaugaucauccccaagaacuucgccgggcccgugucccagcacaacuaccggccgggcuaccacacccagacggccgggcccuggcaccugggcaagcuggagauggacuucgacuucugcgaggggaccaccgucguggugaccgaggacugcggcaaccgcggccccagccuccggacgaccaccgcgagcgggaagcugaucaccgaguggugcugccgcuccugcacgcugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccgggucggcaccaagcacgccauccuccugguggcggugagcuucgucacgcugaucaccgggaacauguccuuccgcgaccucggccgcgugauggugauggucggggccaccaugaccgacgacaucggcaugggcgugacguaccuggcccugcucgccgccuucaaggugcggcccaccuucgcggccgggcugcugcuccgcaagcugaccagcaaggagcugaugauggccaccaucggcaucgcccuccugucccagagcacgauccccgagaccauccuggagcucaccgacgcccuggcgcuggggaugaugguccucaagaucgugcggaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccgcaccagcaagaagcgguccuggccgcucaacgaggccgucauggccgugggcauggugagcauccuggccuccagccugcucaagaacgacauccccaugaccgggccccuggucgccggcgggcugcucacggugugcuacgugcugaccggccgcagcgcggaccuggagcucgagcgggccgccgacgucaagugggaggaccaggccgagaucuccgggagcucccccauccugagcaucaccaucuccgaggacggcagcauguccaucaagaacgaggaggaggagcacacccugacgauccucauccgcaccggccugcuggugaucagcgggguguucccggucuccauccccaucaccgccgcggccugguaccucugggaggugaagaagcagcgggccggcgugcugugggacguccccagcccgccgcccguggggaaggccgagcuggaggacggcgccuaccgcaucaagcagcgggggaucuucggcuacucccagaucggcgcggggguguacaaggagggcaccuuccacaccauguggcacgucacgcgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggccuguucaagaccaacaccgggacgaucggcgcggucagccucgacuucucccccggcaccagcgggucccccaucguggaccgcaagggcaagguggucgggcuguacggcaacggcguggugacccggagcggggccuacgucuccgccaucgcccagaccgagaaguccaucgaggacaaccccgagaucgaggacgacaucuuccgcaagaagcggcugacgaucauggaccuccaccccggcgcggggaagaccaagcgcuaccugcccgccaucgugcgggaggccaucaagcgcggccugcgcacccugauccucgccccgacccggguggucgccgcggagauggaggaggcccugcgcgggcugcccauccgguaccagacgcccgccauccgcgccgagcacaccggccgggagaucguggaccucaugugccacgccaccuucaccaugcgccugcugagccccgugcgggucccgaacuacaaccucaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgcggccugccugcggaagaacggcaagaaggugauccagcugagccgcaagaccuucgacuccgaguacgucaagacccgggccaacgacugggacuucguggugacgaccgacaucagcgagaugggggccaacuuccgcgccgagcgggucaucgacccccgccggugcaugaagcccgugauccucaccgacggcgaggagcgcgugauccuggcggggcccaugccggucacccacuccagcgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgcgagaagguggacgcgaucgacggggaguaccggcugcgcggcgaggcccggaagaccuucguggaccucaugcgccgcggggaccugcccgucuggcuggccuaccgcguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaaggcccgcgacgcccucgacaaccuggccgugcugcacaccgccgaggucggcgggcgggcguacaaccacgcccucaacgagcugcccgagacgcuggagacccuccugcugcucacccugcuggccaccgugacgggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugacgguggucgccgccaccauggcgaacgagaugggguuccuggagaagaccaagaaggaccucggccugggcuccaucaccacgcaggagagcgagagcaacauccuggacaucgaccuccggccggccuccgccuggacccuguacgccguggccaccaccuucgugacgcccaugcugcgccacagcaucgagaacuccagcgucaacgugucccucaccgcgaucgccaaccaggccaccgugcugauggggcugggccgcggguggccccucagcaagauggacaucggcgucccccugcuggccaucgggugcuacucccaggugaacccgaucacccucacggcggcccugcugcuccugguggcccacuacgccaucaucggccccggccugcaggccaaggcgacccgggaggcccagaagcgcaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcggaccaccugggcccucugcgaggcgcugacgcuggccaccggccccaucagcacccucugggaggggaaccccggccgcuucuggaacaccacgaucgccgucuccauggccaacaucuuccggggcagcuaccuggccggggcgggccuccucuucuccaucaugaagaacaccaccaacacccgccgggggacgggcaacaucggcgagacccugggggagaaguggaagucccgccugaacgcccucggcaaguccgaguuccagaucuacaagaaguccgggauccaggagguggaccggacccuggccaaggagggcaucaagcgcggggagaccgaccaccacgccgugucccggggcagcgcgaagcugcgcugguucgucgagcggaacauggugacgccggagggcaagguggucgaccucgggugcggccgcgggggcugguccuacuacugcgggggccugaagaacgugcgggaggugaagggccugaccaagggcgggcccgggcacgaggagcccauccccaugagcaccuacggcuggaaccucguccgccugcaguccgggguggacguguucuucaccccgcccgagaagugcgacacgcugcucugcgacaucggcgagagcagccccaaccccaccaucgaggccggccggacccugcgcguccugaaccucguggagaacuggcugaacaacaacacccaguucugcgugaagguccugaacccguacaugcccuccgugaucgagaagauggagacccuccagcggaaguacgggggcgcccuggugcgcaacccccugagccgcaacuccacgcacgagauguacugggucagcaacgccaccgggaacaucguguccagcgugaacaugaucucccggaugcugaucaaccgcuucaccaugaagcacaagaaggccaccuacgagccggacgucgaccucggcagcgggacgcggaacaucggcaucgagaacgagauccccaaccuggacaucaucggcaagcgcaucgagaagaucaagcaggagcacgagaccuccuggcacuacgaccaggaccaccccuacaagaccugggcguaccacgggagcuacgagaccaagcagacgggcuccgccagcuccauggugaacgggguggucaagcugcucaccaagcccugggacguggugccgauggucacccagauggccaugaccgacacgacccccuucggccagcagcggguguucaaggagaagguggacacccgcacccaggagcccaaggagggcacgaagaagcugaugcggaucaccgccgaguggcuguggaaggagcucgggaagaagaagacgccccgcaugugcacccgggaggaguucacgcgcaagguccggagcaacgccgcgcugggcgccaucuucaccgacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacucccugagcggcguggagggggagggccugcacaagcucggcuacauccugcgcgacgucagcaagaaggagggcggggccauguacgcggacgacaccgccgggugggacacgcggaucacccuggaggaccucaagaacgaggagauggugaccaaccacaugaagggcgagcacaagaagcuggccgaggccaucuucaagcugaccuaccagaacaaggugguccgcgugcagcgcccgacgccccgggggaccgugauggacaucaucucccgcaaggaccagcggggcagcggccaggucgggaccuacggccucaacaccuucacgaacauggaggcccagcugauccgccagauggagggggagggcaucuucaaguccauccagcggcugaccgugaccgaggagaucgcggugcagaacuggcucgcccgcgucggccgggagcgccugagccggauggccaucuccggggacgacugcguggugaagccccuggacgaccgcuucgccagcgcccucaccgcgcugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagaccgccugccucgggaaguccuacgcccagauguggacccugauguacuuccaccggcgcgaccugcggcucgcggccaacgccaucugcagcgccguccccucccacugggugcccaccagccgcaccacgugguccauccacgccaagcacgaguggaugaccaccgaggacaugcuggcgguguggaaccgcgucuggauccaggagaacccguggauggaggacaagacccccguggagagcugggaggaggugcccuaccugggcaagcgggaggaccaguggugcgggucccucaucggccugacgagccgcgccaccugggccaagaacauccagaccgccaucaaccagguccggagccugaucgggaacgaggaguacaccgacuacaugcccuccaugaagcgcuuccggaaggaggaggaggaggcgggcgugcucugguga

SEQ ID NO: 9438 - RNA, 9876 nt, Artificial Sequence
  derived and/or modified CDS sequence (opt1) from DENV-2__EU687243__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacauccgggggaucaugcaggccggcaagcgcucccugcggccgcagcccaccgagcucaaguacagcuggaagacguggggcaaggccaagaugcuguccaccgagagccacaaccagaccuuccugaucgacgggcccgagaccgcggagugcccgaacacgaaccgcgccuggaacucccucgaggucgaggacuacggcuucgggguguucagcaccaacaucuggcugaagcugcgggagaagcaggacguguucugcgacuccaagcucaugagcgccgccaucaaggacaaccgcgccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccggccgggcuaccacacccagacggccgggcccuggcaccugggcaagcuggagauggacuucgacuucugcgaggggaccaccgucguggugaccgaggacugcggcaaccgcggccccagccuccggacgaccaccgcgagcgggaagcugaucaccgaguggugcugccgcuccugcacgcugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccucuuccuggaggagaugcugcgcacccgggucggcaccaagcacgccauccuccugguggcggugagcuucgucacgcugaucaccgggaacauguccuuccgcgaccucggccgcgugauggugauggucggggccaccaugaccgacgacaucggcaugggcgugacguaccuggcccugcucgccgccuucaaggugcggcccaccuucgcggccgggcugcugcuccgcaagcugaccagcaaggagcugaugauggccaccaucggcaucgcccuccugucccagagcacgauccccgagaccauccuggagcucaccgacgcccuggcgcuggggaugaugguccucaagaucgugcggaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccgcaccagcaagaagcgguccuggccgcucaacgaggccgucauggccgugggcauggugagcauccuggccuccagccugcucaagaacgacauccccaugaccgggccccuggucgccggcgggcugcucacggugugcuacgugcugaccggccgcagcgcggaccuggagcucgagcgggccgccgacgucaagugggaggaccaggccgagaucuccgggagcucccccauccugagcaucaccaucuccgaggacggcagcauguccaucaagaacgaggaggaggagcacacccugacgauccucauccgcaccggccugcuggugaucagcgggguguucccggucuccauccccaucaccgccgcggccugguaccucugggaggugaagaagcagcgggccggcgugcugugggacguccccagcccgccgcccguggggaaggccgagcuggaggacggcgccuaccgcaucaagcagcgggggaucuucggcuacucccagaucggcgcggggguguacaaggagggcaccuuccacaccauguggcacgucacgcgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggccuguucaagaccaacaccgggacgaucggcgcggucagccucgacuucucccccggcaccagcgggucccccaucguggaccgcaagggcaagguggucgggcuguacggcaacggcguggugacccggagcggggccuacgucuccgccaucgcccagaccgagaaguccaucgaggacaaccccgagaucgaggacgacaucuuccgcaagaagcggcugacgaucauggaccuccaccccggcgcggggaagaccaagcgcuaccugcccgccaucgugcgggaggccaucaagcgcggccugcgcacccugauccucgccccgacccggguggucgccgcggagauggaggaggcccugcgcgggcugcccauccgguaccagacgcccgccauccgcgccgagcacaccggccgggagaucguggaccucaugugccacgccaccuucaccaugcgccugcugagccccgugcgggucccgaacuacaaccucaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgcggccugccugcggaagaacggcaagaaggugauccagcugagccgcaagaccuucgacuccgaguacgucaagacccgggccaacgacugggacuucguggugacgaccgacaucagcgagaugggggccaacuuccgcgccgagcgggucaucgacccccgccggugcaugaagcccgugauccucaccgacggcgaggagcgcgugauccuggcggggcccaugccggucacccacuccagcgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgcgagaagguggacgcgaucgacggggaguaccggcugcgcggcgaggcccggaagaccuucguggaccucaugcgccgcggggaccugcccgucuggcuggccuaccgcguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaaggcccgcgacgcccucgacaaccuggccgugcugcacaccgccgaggucggcgggcgggcguacaaccacgcccucaacgagcugcccgagacgcuggagacccuccugcugcucacccugcuggccaccgugacgggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugacgguggucgccgccaccauggcgaacgagaugggguuccuggagaagaccaagaaggaccucggccugggcuccaucaccacgcaggagagcgagagcaacauccuggacaucgaccuccggccggccuccgccuggacccuguacgccguggccaccaccuucgugacgcccaugcugcgccacagcaucgagaacuccagcgucaacgugucccucaccgcgaucgccaaccaggccaccgugcugauggggcugggccgcggguggccccucagcaagauggacaucggcgucccccugcuggccaucgggugcuacucccaggugaacccgaucacccucacggcggcccugcugcuccugguggcccacuacgccaucaucggccccggccugcaggccaaggcgacccgggaggcccagaagcgcaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcggaccaccugggcccucugcgaggcgcugacgcuggccaccggccccaucagcacccucugggaggggaaccccggccgcuucuggaacaccacgaucgccgucuccauggccaacaucuuccggggcagcuaccuggccggggcgggccuccucuucuccaucaugaagaacaccaccaacacccgccgggggacgggcaacaucggcgagacccugggggagaaguggaagucccgccugaacgcccucggcaaguccgaguuccagaucuacaagaaguccgggauccaggagguggaccggacccuggccaaggagggcaucaagcgcggggagaccgaccaccacgccgugucccggggcagcgcgaagcugcgcugguucgucgagcggaacauggugacgccggagggcaagguggucgaccucgggugcggccgcgggggcugguccuacuacugcgggggccugaagaacgugcgggaggugaagggccugaccaagggcgggcccgggcacgaggagcccauccccaugagcaccuacggcuggaaccucguccgccugcaguccgggguggacguguucuucaccccgcccgagaagugcgacacgcugcucugcgacaucggcgagagcagccccaaccccaccaucgaggccggccggacccugcgcguccugaaccucguggagaacuggcugaacaacaacacccaguucugcgugaagguccugaacccguacaugcccuccgugaucgagaagauggagacccuccagcggaaguacgggggcgcccuggugcgcaacccccugagccgcaacuccacgcacgagauguacugggucagcaacgccaccgggaacaucguguccagcgugaacaugaucucccggaugcugaucaaccgcuucaccaugaagcacaagaaggccaccuacgagccggacgucgaccucggcagcgggacgcggaacaucggcaucgagaacgagauccccaaccuggacaucaucggcaagcgcaucgagaagaucaagcaggagcacgagaccuccuggcacuacgaccaggaccaccccuacaagaccugggcguaccacgggagcuacgagaccaagcagacgggcuccgccagcuccauggugaacgggguggucaagcugcucaccaagcccugggacguggugccgauggucacccagauggccaugaccgacacgacccccuucggccagcagcggguguucaaggagaagguggacacccgcacccaggagcccaaggagggcacgaagaagcugaugcggaucaccgccgaguggcuguggaaggagcucgggaagaagaagacgccccgcaugugcacccgggaggaguucacgcgcaagguccggagcaacgccgcgcugggcgccaucuucaccgacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggggaacucccugagcggcguggagggggagggccugcacaagcucggcuacauccugcgcgacgucagcaagaaggagggcggggccauguacgcggacgacaccgccgggugggacacgcggaucacccuggaggaccucaagaacgaggagauggugaccaaccacaugaagggcgagcacaagaagcuggccgaggccaucuucaagcugaccuaccagaacaaggugguccgcgugcagcgcccgacgccccgggggaccgugauggacaucaucucccgcaaggaccagcggggcagcggccaggucgggaccuacggccucaacaccuucacgaacauggaggcccagcugauccgccagauggagggggagggcaucuucaaguccauccagcggcugaccgugaccgaggagaucgcggugcagaacuggcucgcccgcgucggccgggagcgccugagccggauggccaucuccggggacgacugcguggugaagccccuggacgaccgcuucgccagcgcccucaccgcgcugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagaccgccugccucgggaaguccuacgcccagauguggacccugauguacuuccaccggcgcgaccugcggcucgcggccaacgccaucugcagcgccguccccucccacugggugcccaccagccgcaccacgugguccauccacgccaagcacgaguggaugaccaccgaggacaugcuggcgguguggaaccgcgucuggauccaggagaacccguggauggaggacaagacccccguggagagcugggaggaggugcccuaccugggcaagcgggaggaccaguggugcgggucccucaucggccugacgagccgcgccaccugggccaagaacauccagaccgccaucaaccagguccggagccugaucgggaacgaggaguacaccgacuacaugcccuccaugaagcgcuuccggaaggaggaggaggaggcgggcgugcucugguga

SEQ ID NO: 9439 - RNA, 9876 nt, Artificial Sequence
  derived and/or modified CDS sequence (opt1) from DENV-2__EU687245__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacucccagaucggcgcggggguguacaaggagggcaccuuccacaccauguggcacgucacgcgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucagccucgacuucucccccggcaccagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugagccccgugcgcgucccgaacuacaaccucaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgucugguucgugccguccaucaaggccggcaacgacaucgcggccugccugcgcaagaacggcaagaaggugauccagcugagccggaagaccuucgacuccgaguacgucaagacccgcgccaacgacugggacuucguggugacgaccgacaucagcgagaugggggccaacuuccgggccgagcgcgucaucgacccccggcgcugcaugaagcccgugauccucaccgacggcgaggagcgggugauccuggcggggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucaacgagcugcccgagacgcuggagacccuccugcugcucacccugcuggccaccgugacgggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcuccaucaccacgcaggagagcgagagcaacauccuggacaucgaccuccgcccggccuccgccuggacccuguacgccguggccaccaccuucgugacgcccaugcugcggcacagcaucgagaacuccagcgucaacgugucccucaccgcgaucgccaaccaggccaccgugcugauggggcugggccgcggguggccccucagcaagauggacaucggcgucccccugcuggccaucgggugcuacucccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucagcacccucugggaggggaaccccggccgguucuggaacaccacgaucgccgucuccauggccaacaucuuccgcggcagcuaccuggccggggcgggccuccucuucuccaucaugaagaacaccaccaacgcccggcgcgggaccggcaacaucggcgagacgcugggggagaaguggaagucccggcugaacgcccucggcaaguccgaguuccagaucuacaagaaguccgggauccaggagguggaccgcacccuggccaaggagggcaucaagcgcggggagaccgaccaccacgcggugucccgcggcagcgccaagcugcggugguucgucgagcgcaacauggugaccccggagggcaagguggucgaccucgggugcggccgcggcgggugguccuacuacugcggcgggcugaagaacgugcgcgaggugaaggggcugacgaagggcgggcccgggcacgaggagcccauccccaugagcaccuacggcuggaaccucguccggcugcaguccgggguggacguguucuucaccccgcccgagaagugcgacacccugcucugcgacaucggcgagagcagccccaaccccacgaucgaggccggccgcacccugcggguccugaaccucguggagaacuggcugaacaacaacacccaguucugcgugaagguccugaacccguacaugcccuccgugaucgagaagauggagacccuccagcgcaaguacgggggcgcccuggugcggaacccccugagccgcaacuccacccacgagauguacugggucagcaacgccacggggaacaucguguccagcgugaacaugaucucccgcaugcugaucaaccgguucaccaugaagcacaagaaggcgaccuacgagccggacgucgaccucggcagcgggacccgcaacaucggcaucgagaacgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacgggguggucaagcugcucacgaagcccugggacguggugccgauggucacccagauggccaugaccgacaccacgcccuucggccagcagcgcguguucaaggagaagguggacacccggacccaggagcccaaggagggcaccaagaagcugaugcgcaucacggccgaguggcuguggaaggagcucgggaagaagaagacgccccggaugugcacccgcgaggaguucacccggaagguccgcagcaacgcggcccugggcgccaucuucacggacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacucccugagcggcguggagggggagggccugcacaagcucggcuacauccugcgggacgucagcaagaaggagggcggggcgauguacgccgacgacaccgccgggugggacacccgcaucacgcuggaggaccucaagaacgaggagauggugaccaaccacaugaagggcgagcacaagaagcuggccgaggccaucuucaagcugaccuaccagaacaaggugguccgggugcagcgcccgaccucccgcgggacggugauggacaucaucagccggaaggaccagcgcggcuccggccaggucgggaccuacggccucaacaccuucaccaacauggaggcgcagcugauccggcagauggagggggagggcaucuucaagagcauccagcgccugacggugaccgaggagaucgccgugcagaacuggcucgcccgggucggccgcgagcggcugucccgcauggccaucagcggggacgacugcguggugaagccccuggacgaccgguucgccuccgcgcucaccgcccugaacgacaugggcaagguccgcaaggacauccagcagugggagcccagccggggguggaacgacuggacccaggugcccuucugcucccaccacuuccacgagcuggugaugaaggacggccgcguccucguggugccgugccggaaccaggacgagcugaucgggcgcgcccggaucagccagggcgccggcuggucccugaaggagacggccugccucggcaagagcuacgcgcagauguggacccugauguacuuccaccgccgggaccugcgccucgccgccaacgccaucugcuccgccguccccagccacugggugcccaccucccggaccaccuggagcauccacgcgaagcacgaguggaugacgaccgaggacaugcuggccguguggaaccgcgucuggauccaggagaaccccuggauggaggacaagaccccgguggaguccugggaggaggugcccuaccugggcaagcgcgaggaccaguggugcgggagccucaucggccugaccagccgggccacgugggccaagaacauccagaccgcggucaaccaggugcgcucccugaucgggaacgaggaguacaccgacuacaugcccagcaugaagcgguuccgcaaggaggaggaggaggccggcgugcucugguga

SEQ ID NO: 9440 - RNA, 9873 nt, Artificial Sequence
  derived and/or modified CDS sequence (opt1) from DENV-2__HQ541798__SS-prME
accgccggcaugaucuucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccggcgcgagaagcggagcgucgcccuggugccccacguggggaugggccucgagacccgcaccgagaccuggauguccagcgagggggccuggaagcacgcccagcggaucgagaccuggauccugcgccaccccggcuucaccaucauggccgcgauccuggccuacaccaucgggaccacccacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggacuucgagcugaucaagaccgaggccaagcagagcgccacccuccgcaaguacugcaucgaggccaagcugacgaacaccaccaccgagucccggugccccacgcagggcgagccgagccugaacgaggagcaggacaagcgcuucgucugcaagcacuccaugguggaccggggcugggggaacggcugcggccuguucggcaagggcgggaucgugaccugcgcgauguucacgugcaagaaggacaugaagggcgaggucgugcagcccgagaaccuggaguacaccaucgugaucacgccccacagcggggaggagcacgccgucggcaacgacaccgggaagcacggcaaggagaucaagaucacgccccaguccagcaucaccgaggccgagcugaccggguacggcacggugaccauggagugcuccccgcgcaccggccucgacuucaacgagauggugcugcugcagauggagaacaaggccuggcucguccaccggcagugguuccuggaccugccccuccccuggcugcccggggccgacacccagggcagcaacuggauccagaaggagacgcuggugaccuucaagaacccgcacgcgaagaagcaggacguggucgugcucgggagccaggagggcgccaugcacaccgcccugaccggggccacggagauccagauguccagcggcaaccuccucuucaccggccaccugaagugccgccugcggauggacaagcuccagcugaaggggauguccuacagcaugugcaccggcaaguucaaggucgugaaggagaucgccgagacccagcacgggacgaucgugauccgcguccaguacgagggcgacggcucccccugcaagauccccuucgagaucauggaccuggagaagcggcacgugcucgggcgccugaucaccgugaaccccaucgucaccgagaaggacagcccggugaacaucgaggcggagccgcccuucggcgacuccuacaucaucaucgggguggagcccggccagcugaagcucaacugguucaagaaggggagcuccaucggccagaugcuggagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcagcgggaucuucaucaccgacaacgugcacacguggaccgagcaguacaaguuccagccggagucccccagcaagcuggcguccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccccagccgaccgagcucaaguacuccuggaagaccuggggcaaggccaagaugcugagcacggagucccacaaccagaccuuccugaucgacgggcccgagaccgcggagugccccaacaccaaccgggccuggaacagccucgagguggaggacuacggcuucgggguguucacgaccaacaucuggcugaagcugcgcgagaagcaggacgucuucugcgacuccaagcucaugagcgccgccaucaaggacaaccgggccgugcacgcggacaugggcuacuggaucgaguccgcccugaacgacaccuggaagaucgagaaggccagcuucaucgaggugaaguccugccacuggccgaagccccacacccuguggagcaacgagguccucgaguccgagaugaucauccccaagaacuucgccggccccgugagccagcacaacuaccgcccgggguaccacacccagacggccggccccuggcaccuggggaagcuggagauggacuucgacuucugcgagggcaccaccguggucgugaccgaggacugcgggaaccggggccccagccuccgcacgaccaccgcguccggcaagcugaucaccgaguggugcugccggagcugcacgcugcccccgcuccgcuaccgcggggaggacggcugcugguacgggauggagauccgcccccugaaggagaaggaggagaaccuggugaacucccucgucaccgccggccacgggcagaucgacaacuucagccugggcgugcugggcauggcccucuuccuggaggagaugcugcggacccgcguggggaccaagcacgccauccuccuggucgcgguguccuucgugacgcugaucaccggcaacaugagcuuccgggaccucgggcgcgucauggugauggugggcgccaccaugaccgacgacaucgggaugggcgucacguaccuggcccugcucgccgccuucaaggugcgccccaccuucgcggccggccugcugcuccggaagcugaccuccaaggagcugaugaugaccacgaucgggaucgugcuccugagccaguccaccauccccgagaccauccuggagcucaccgacgcccuggcccugggcaugaugguccucaagauggugcgcaagauggagaaguaccagcuggccgugacgaucauggcgauccugugcgucccgaacgccgugauccuccagaacgccuggaaggucagcugcaccauccuggccgugguguccgucagcccccuguuccucaccuccagccagcagaaggccgacuggaucccccuggcgcugaccaucaaggggcucaaccccacggccaucuuccugaccacccugucccggaccaacaagaagcgcagcuggccgcucaacgaggccaucauggccgugggcaugguguccauccuggcgagcucccugcucaagaacgacauccccaugacgggcccccuggucgccgggggccugcucaccgugugcuacgugcugaccgggcggagcgccgaccuggagcucgagcgcgccgccgacgucaagugggaggaccaggcggagaucagcggcuccagccccauccuguccaucaccaucagcgaggacggguccaugagcaucaagaacgaggaggaggagcagacgcugaccauccucauccggaccggccugcuggugaucuccggccucuucccggugagccugcccaucaccgccgccgccugguaccugugggaggucaagaagcagcgcgccggggugcucugggacgugcccagcccgccgcccgucggcaaggcggagcuggaggacggggccuaccggaucaagcagaagggcauccugggguacagccagaucggcgccggcguguacaaggaggggaccuuccacacgauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagaccaagcccgggcuguucaagaccaacgccggcacgaucggggccgugucccucgacuucagccccggcaccuccggcagccccaucaucgacaagaaggggaaggucgugggccuguacgggaacggcguggucacccgguccggcgccuacgugagcgcgaucgcccagaccgagaaguccaucgaggacaaccccgagaucgaggacgacaucuuccgcaagcggaagcugacgaucauggaccugcaccccggggccggcaagaccaagcgcuaccuccccgccaucgugcgggaggcgaucaagcgcgggcugcggacccugauccucgccccgacccgcgucguggccgccgagauggaggaggcccugcggggccugcccauccgcuaccagacgcccgcgauccgcgccgagcacaccgggcgggagaucguggaccucaugugccacgccaccuucaccaugcgccugcugagccccguccgggugccgaacuacaaccucaucaucauggacgaggcccacuucacggaccccgccagcaucgcggcccgcggcuacaucuccacccggguggagaugggcgaggccgccgggaucuucaugaccgccacgccgcccggcagccgcgacccguucccccaguccaacgcgcccaucauggacgaggagcgggagauccccgagcgcagcugguccagcgggcacgagugggucacggacuucaagggcaagaccgugugguucgugccguccaucaaggccgggaacgacaucgccgccugccugcggaagaacggcaagaaggucauccagcugagccgcaagaccuucgacuccgaguacgugaagacccggacgaacgacugggacuucguggucaccaccgacaucagcgagaugggcgcgaacuucaaggccgagcgcgugaucgacccccggcgcugcaugaagcccgugauccucaccgacggggaggagcgggucauccuggccggccccaugccggugacgcacuccagcgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgcgagaagguggacgccaucgacggcgaguaccgccugcgcggggaggcccgcaagaccuucgucgaccucaugcggcgcggcgaccugcccguguggcuggccuaccggguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgcggccggccggaagucccugacgcucagccugaucaccgagaugggccgccugcccaccuucaugacccagaaggcccgggacgcccucgacaaccuggcgguccugcacacggccgaggccgggggccgcgccuacaaccacgcccucuccgagcugcccgagacccuggagacccuccugcugcucacccugcuggcgacggugaccgggggcaucuuccucuuccugaugagcggccgggggaucggcaagaugacccuggggaugugcugcaucaucaccgccuccauccuccugugguacgcccagauccagccgcacuggaucgccgccagcaucauccuggaguucuuccucaucgugcugcugauccccgagcccgagaagcagcgcacgccccaggacaaccagcucacguacgucgugaucgcgauccugaccguggucgccgccaccauggccaacgagaugggcuuccuggagaagaccaagaaggaccucgggcugggcagcaucacgacccagcagccggaguccaacauccuggacaucgaccuccggcccgccagcgcguggacccuguacgccguggccaccacguucgugacccccaugcugcgccacuccaucgagaacagcuccgucaacgugagccucaccgccaucgccaaccaggcgaccgugcugaugggccuggggaagggcuggccccucuccaagauggacaucggggucccgcugcuggccaucggcugcuacagccaggugaaccccaucacgcucaccgccgcccuguuccugcucguggcgcacuacgccaucaucgggcccggccugcaggccaaggccacccgggaggcccagaagcgcgcggccgccggcaucaugaagaaccccaccgucgacgggaucacggugaucgaccuggacccgauccccuacgaccccaaguucgagaagcagcucggccaggugaugcugcugguccucugcgugacccaggugcugaugaugcggaccaccugggcccugugcgaggcccucacgcuggcgaccgggcccaucuccacccugugggagggcaacccggggcgcuucuggaacaccacgaucgccgucagcauggccaacaucuuccgcggcuccuaccucgccggcgccgggcugcuguucagcaucaugaagaacaccaccaacacccggcgcggcacggggaacaucggcgagacccucggcgagaaguggaagucccggcugaacgcgcuggggaaguccgaguuccagaucuacaagaaguccggcauccaggagguggaccgcacccucgccaaggaggggaucaagcggggcgagaccgaccaccacgccgugagccgcggguccgccaagcugcggugguucgucgagcgcaacauggugacgcccgagggcaagguggucgaccugggcugcgggcggggcggguggagcuacuacugcggcgggcucaagaacgugcgcgaggugaagggccugaccaagggcgggcccggccacgaggagcccaucccgauguccaccuacggguggaaccugguccggcuccagagcggcguggacguguucuucacgccgcccgagaagugcgacacgcugcugugcgacaucggggagagcucccccaacccgaccgucgaggcgggccgcacccuccgggugcugaaccugguggagaacuggcucaacaacaacacccaguucugcaucaagguccugaaccccuacaugcccagcgugaucgagaagauggaggcccugcagcgcaaguacggcggggcccuggugcggaacccgcucucccgcaacagcacccacgagauguacugggucuccaacgccagcggcaacaucguguccagcgugaacaugaucucccggaugcugaucaaccgcuucacgaugcggcacaagaaggccaccuacgagcccgacgucgaccuggggagcggcacccgcaacaucgggaucgaguccgagauccccaaccucgacaucaucggcaagcgcaucaagaucaagcaggagcacgagaccagcuggcacuacgaccaggaccaccccuacaagacgugggcguaccacggcuccuacgagaccaagcagaccgggagcgccuccagcauggugaacggcgugguccggcugcugaccaagccgugggacguggugcccauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaagaagaagacgccgcgcaugugcacccgggaggaguucacccgcaagguccgguccaacgccgcgcucggggccaucuucaccgacgagaacaaguggaaguccgcccgcgaggccguggaggacucccgguucugggagcuggucgacaaggagcgcaaccugcaccucgagggcaagugcgagacgugcguguacaacaugauggggaagcgggagaagaagcugggcgaguucgggaaggccaagggcagccgcgcgaucugguacauguggcugggcgcccgguuccucgaguucgaggcccugggguuccugaacgaggaccacugguucagccgcgagaacucccucagcggcguggagggggagggccugcacaagcugggguacauccuccgggacgucuccaagaaggagggcggcgccauguacgcggacgacaccgccgggugggacacccgcaucacccuggaggaccugaagaacgaggagauggugacgaaccacauggagggcgagcacaagaagcucgccgaggccaucuucaagcugaccuaccagaacaaggugguccgggugcagcgccccacgccccgggggaccgugauggacaucaucagccgccgggaccagcgcggcuccgggcaggucggcacguacggccugaacaccuucaccaacauggaggcccagcucauccgccagauggagggggagggcguguucaagagcauccagcaccugaccgugacggaggagaucgcgguccagaacuggcuggcccggguggggcgcgagcggcucucccgcauggccaucagcggcgacgacugcguggucaagccccuggacgaccgguucgccuccgcccugaccgcgcucaacgacaugggcaaggugcgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccguccccucccacugggugccgacgagccgcaccaccuggagcauccacgccaagcacgaguggaugaccgcggaggacaugcucaccguguggaaccgggucuggauccaggagaaccccuggauggaggacaagacgcccguggaguccugggaggagauccccuaccugggcaagcgcgaggaccaguggugcgggagccugaucggccucaccucccgggccaccugggccaagaacauccagaccgccaucaaccaggugcgcagccugaucgggaacgaggaguacacggacuacaugccguccaugaagcgcuuccggcgcgaggaggaggaggcgggcguccugugguga

SEQ ID NO: 9441 - RNA, 9876 nt, Artificial Sequence
  derived and/or modified CDS sequence (opt1) from DENV-2__JF730053__SS-prME
accgccggcaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcggagcgucgcccuggugccccacguggggaugggccucgagacccgcaccgagaccuggaugagcagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccagcaugaccaugcgcugcaucggcaucagcaaccgggacuucguggagggcguguccgggggcagcugggucgacaucgugcucgagcacggguccugcgugaccacgauggccaagaacaagcccacccuggacuucgagcugaucaagaccgaggccaagcagagcgccacccuccgcaaguacugcaucgaggccaagcugacgaacaccaccaccgagucccggugccccacgcagggcgagcccagccugaacgaggagcaggacaagcgcuucgucugcaagcacuccaugguggaccggggcugggggaacggcugcggccuguucggcaagggcgggaucgugaccugcgcgauguucacgugcaagaagaacaugaagggcaaggucgugcagcccgagaaccuggaguacaccaucgugaucacgccccacagcggggaggagcacgccgucggcaacgacaccgggaagcacggcaaggagaucaagaucacgccccaguccagcaucaccgaggccgagcugaccggguacggcacggugaccauggagugcuccccgcgcaccggccucgacuucaacgagauggugcugcugcagauggagaacaaggccuggcucguccaccggcagugguuccuggaccugccccuccccuggcugcccggggccgacacccagggcagcaacuggauccagaaggagacgcuggugaccuucaagaacccgcacgcgaagaagcaggacguggucgugcucgggagccaggagggcgccaugcacaccgcccugaccggggccacggagauccagauguccagcggcaaccuccucuucaccggccaccugaagugccgccugcggauggacaagcuccagcugaaggggauguccuacagcaugugcaccggcaaguucaaggucgugaaggagaucgccgagacccagcacgggacgaucgugauccgcguccaguacgagggcgacggcucccccugcaagauccccuucgagaucauggaccuggagaagcggcacgugcucgggcgccugaucaccgugaaccccaucgucaccgagaaggacagcccggugaacaucgaggcggagccgcccuucggcgacuccuacaucaucaucgggguggagcccggccagcugaagcucaacugguucaagaaggggagcuccaucggccagaugcuggagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcagcgggaucuucaucaccgacaacgugcacacguggaccgagcaguacaaguuccagccggagucccccagcaagcuggcguccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccccagccgaccgagcucaaguacuccuggaagaccuggggcaaggccaagaugcugagcacggagucccacaaccagaccuuccugaucgacgggcccgagaccgcggagugccccaacaccaaccgggccuggaacagccucgagguggaggacuacggcuucgggguguucacgaccaacaucuggcugaagcugcgcgagaagcaggacgucuucugcgacuccaagcucaugagcgccgccaucaaggacaaccgggccgugcacgcggacaugggcuacuggaucgaguccgcccugaacgacaccuggaagaucgagaaggccagcuucaucgaggugaaguccugccacuggcccaagagccacacccugugguccaacgagguccucgagagcgagaugaucauccccaagaacuucgccggccccgugagccagcacaacuaccgccccggguaccacacccagacggccggcccguggcaccuggggaagcuggagauggacuucgacuucugcgagggcaccaccguggucgugaccgaggacugcgggaaccggggccccucccuccgcacgaccaccgcgagcggcaagcugaucaccgaguggugcugccgguccugcacgcugccgccccuccgcuaccgcggggaggacggcugcugguacgggauggagauccgcccgcugaaggagaaggaggagaaccuggugaacagccucgucaccgccggccacgggcagaucgacaacuucucccugggcgugcugggcauggcccucuuccuggaggagaugcugcggacccgcguggggaccaagcacgccauccuccuggucgcggugagcuucgugacgcugaucaccggcaacauguccuuccgggaccucgggcgcgucauggugauggugggcgccaccaugaccgacgacaucgggaugggcgucacguaccuggcccugcucgccgccuucaaggugcgccccaccuucgcggccggccugcugcuccggaagcugaccagcaaggagcugaugaugaccacgaucgggaucgugcuccugucccagagcaccauccccgagaccauccuggagcucaccgacgcccuggcccugggcaugaugguccucaagauggugcgcaagauggagaaguaccagcuggccgugacgaucauggcgauccugugcguccccaacgccgugauccuccagaacgccuggaaggucuccugcaccauccuggccguggugagcgucuccccgcuguuccucaccagcucccagcagaaggccgacuggaucccccuggcgcugaccaucaaggggcucaaccccacggccaucuuccugaccacccugagccggaccaacaagaagcgcuccuggccccucaacgaggccaucauggccgugggcauggugagcauccuggcguccagccugcucaagaacgacaucccgaugacgggcccccuggucgccgggggccugcucaccgugugcuacgugcugaccgggcggagcgccgaccuggagcucgagcgcgccgccgacgucaagugggaggaccaggcggagaucuccggcagcucccccauccugagcaucaccaucuccgaggacgggagcauguccaucaagaacgaggaggaggagcagacgcugaccauccucauccggaccggccugcuggugaucagcggccucuuccccgugucccugccgaucaccgccgccgccugguaccugugggaggucaagaagcagcgcgccggggugcucugggacgugcccuccccgccgcccgucggcaaggcggagcuggaggacggggccuaccggaucaagcagaagggcauccugggguacucccagaucggcgccggcguguacaaggaggggaccuuccacacgauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcgcuggagcccggcaagaacccgcgcgccgugcagaccaagcccgggcuguucaagaccaacgccggcacgaucggggccgugagccucgacuucucccccggcaccagcggcucccccaucaucgacaagaaggggaaggucgugggccuguacgggaacggcguggucacccggagcggcgccuacguguccgcgaucgcccagaccgagaaguccaucgaggacaacccggagaucgaggacgacaucuuccgcaagcggaagcugacgaucauggaccugcaccccggggccggcaagaccaagcgcuaccuccccgccaucgugcgggaggcgaucaagcgcgggcugcggacccugauccucgcccccacccgcgucguggccgccgagauggaggaggcccugcggggccugccgauccgcuaccagacgcccgcgauccgcgccgagcacaccgggcgggagaucguggaccucaugugccacgccaccuucaccaugcgccugcugagccccguccgggugcccaacuacaaccucaucaucauggacgaggcccacuucacggacccggccuccaucgcggcccgcggcuacaucagcacccggguggagaugggcgaggccgccgggaucuucaugaccgccacgccgcccggcucccgcgaccccuucccgcagagcaacgcgcccaucauggacgaggagcgggagauccccgagcgcuccuggagcuccgggcacgagugggucacggacuucaagggcaagaccgugugguucgugcccagcaucaaggccgggaacgacaucgccgccugccugcggaagaacggcaagaaggucauccagcugucccgcaagaccuucgacagcgaguacgugaagacccggacgaacgacugggacuucguggucaccaccgacaucuccgagaugggcgcgaacuucaaggccgagcgcgugaucgacccgcggcgcugcaugaagcccgugauccucaccgacggggaggagcgggucauccuggccggccccaugcccgugacgcacagcuccgccgcccagcgccgggggcgcaucggccggaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccgccugcgcggggaggcccgcaagaccuucgucgaccucaugcggcgcggcgaccugcccguguggcuggccuaccggguggcggccgaggggaucaacuacgccgaccgccgguggugcuucgacggcaucaagaacaaccagauccucgaggagaacgucgagguggagaucuggaccaaggagggggagcgcaagaagcugaagccccgguggcuggacgcccgcaucuacuccgacccgcucgcccugaaggaguucaaggaguucgcggccggccgcaagagccugacgcucucccugaucaccgagaugggccgccugcccaccuucaugacccagaaggcccgggacgcccucgacaaccuggcgguccugcacacggccgaggccgggggccgcgccuacaaccacgcccucagcgagcugcccgagacccuggagacccuccugcugcucacccugcuggcgacggugaccgggggcaucuuccucuuccugauguccggccgggggaucggcaagaugacccuggggaugugcugcaucaucaccgccagcauccuccugugguacgcccagauccagccccacuggaucgccgccagcaucauccuggaguucuuccucaucgugcugcugaucccggagcccgagaagcagcgcacgccccaggacaaccagcucacguacgucgugaucgcgauccugaccguggucgccgccaccauggccaacgagaugggcuuccuggagaagaccaagaaggaccucgggcugggcuccaucacgacccagcagcccgagagcaacauccuggacaucgaccuccggccggccuccgcguggacccuguacgccguggccaccacguucgugacccccaugcugcgccacagcaucgagaacuccagcgucaacgugucccucaccgccaucgccaaccaggcgaccgugcugaugggccuggggaagggcuggccccucagcaagauggacaucggggucccccugcuggccaucggcugcuacucccaggugaacccgaucacgcucaccgccgcccuguuccugcucguggcgcacuacgccaucaucgggcccggccugcaggccaaggccacccgggaggcccagaagcgcgcggccgccggcaucaugaagaaccccaccgucgacgggaucacggugaucgaccuggaccccaucccguacgaccccaaguucgagaagcagcucggccaggugaugcugcugguccucugcgugacccaggugcugaugaugcggaccaccugggcccugugcgaggcccucacgcuggcgaccgggcccaucagcacccugugggagggcaaccccgggcgcuucuggaacaccacgaucgccgucuccauggccaacaucuuccgcggcagcuaccucgccggcgccgggcugcuguucuccaucaugaagaacaccaccaacacccggcgcggcacggggaacaucggcgagacccucggcgagaaguggaagucccggcugaacgcgcuggggaaguccgaguuccagaucuacaagaaguccggcauccaggagguggaccgcacccucgccaaggaggggaucaagcggggcgagaccgaccaccacgccgugucccgcgggagcgccaagcugcggugguucgucgagcgcaacauggugacgccggagggcaagguggucgaccugggcugcgggcggggcgggugguccuacuacugcggcgggcucaagaacgugcgcgaggugaagggccugaccaagggcgggcccggccacgaggagcccauccccaugagcaccuacggguggaaccugguccggcuccagagcggcguggacguguucuucaccccgcccgagaagugcgacacgcugcugugcgacaucggggaguccagccccaaccccaccgucgaggcgggccgcacccuccgggugcugaaccugguggagaacuggcucaacaacaacacccaguucugcaucaagguccugaacccguacaugcccuccgugaucgagaagauggaggcccugcagcgcaaguacggcggggcccuggugcggaacccccucagccgcaacuccacccacgagauguacugggucagcaacgccuccggcaacaucgugagcuccgugaacaugaucagccggaugcugaucaaccgcuucacgaugcggcacaagaaggccaccuacgagccggacgucgaccugggguccggcacccgcaacaucgggaucgagagcgagauccccaaccucgacaucaucggcaagcgcaucgagaagaucaagcaggagcacgagaccuccuggcacuacgaccaggaccaccccuacaagacgugggcguaccacggcagcuacgagaccaagcagaccggguccgccagcuccauggugaacggcgugguccggcugcugaccaagcccugggacguggugccgauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaagaagaagacgccccgcaugugcacccgggaggaguucacccgcaagguccggagcaacgccgcgcucggggccaucuucaccgacgagaacaaguggaaguccgcccgcgaggccguggaggacagccgguucugggagcuggucgacaaggagcgcaaccugcaccucgagggcaagugcgagacgugcguguacaacaugauggggaagcgggagaagaagcugggcgaguucgggaaggccaagggcagccgcgcgaucugguacauguggcugggcgcccgguuccucgaguucgaggcccugggguuccugaacgaggaccacugguucucccgcgagaacagccucuccggcguggagggggagggccugcacaagcugggguacauccuccgggacgucagcaagaaggagggcggcgccauguacgcggacgacaccgccgggugggacacccgcaucacccuggaggaccugaagaacgaggagauggugacgaaccacauggagggcgagcacaagaagcucgccgaggccaucuucaagcugaccuaccagaacaaggugguccgggugcagcgcccgacgccccgggggaccgugauggacaucaucucccgccgggaccagcgcggcagcgggcaggucggcaccuacggccugaacaccuucaccaacauggaggcccagcucauccgccagauggagggggagggcguguucaaguccauccagcaccugaccgugacggaggagaucgcgguccagaacuggcuggcccggguggggcgcgagcggcucagccgcauggccaucuccggcgacgacugcguggucaagccccuggacgaccgguucgccagcgcccugaccgcgcucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugcccacgagccgcaccaccugguccauccacgccaagcacgaguggaugaccgcggaggacaugcucaccguguggaaccgggucuggauccaggagaacccguggauggaggacaagacgcccguggagagcugggaggagauccccuaccugggcaagcgcgaggaccaguggugcgggucccugaucggccucaccagccgggccaccugggccaagaacauccagaccgccaucaaccaggugcgcucccugaucgggaacgaggaguacacggacuacaugcccagcaugaagcgcuuccggcgcgaggaggaggaggcgggcguccugugguga

SEQ ID NO: 9442 - RNA, 9876 nt, Artificial Sequence
  derived and/or modified CDS sequence (opt1) from DENV-2__EU529706__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccaggucuucggggcgaucuacggcgccgccuucagcgggguguccuggaccaugaagauccugaucggcgugaucaucacguggaucgggaugaacagccgcuccaccagccuguccgucagccuggugcucgugggcgucgugacccuguaccugggggugaugguccaggccgacaccggcugcgugguguccuggaagaacaaggagcucaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccuggagaaccucauguggaagcagaucacgcccgagcugaaccacauccugagcgagaacgaggugaagcucaccaucaugaccggcgacaucaaggggaucaugcaggccggcaagcggucccugcgcccgcagcccaccgagcugaaguacagcuggaagacguggggcaaggccaagaugcucuccaccgagagccacaaccagaccuuccugaucgacgggcccgagaccgcggagugcccgaacacgaaccgggccuggaacucccuggaggucgaggacuacggcuucgggguguucagcaccaacaucuggcucaagcugcgcgagaagcaggacguguucugcgacuccaagcugaugagcgccgccaucaaggacaaccgggccguccacgcggacaugggcuacuggaucgaguccgcccucaacgacaccuggaagauggagaaggccagcuucaucgagaucaaguccugccacuggcccaagagccacacccugugguccaacggcgugcuggagagcgagaugaucauccccaagaacuucgccgggcccgugucccagcacaacuaccgcccgggcuaccacacccagacggccgggcccuggcaccucggcaagcuggagauggacuucgaccugugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcaucggcaccaagcacgccauccuccuggucgcggugagcuucgugacgcugaucaccgggaacauguccuuccgggaccucggccgcgucauggugauggugggggccaccaugaccgacgacaucggcaugggcgucacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugauggugcucaagaucguccgcaacauggagaaguaccagcuggccgugaccaucauggccaucuccugcgugccgaacgccgucauccugcagaacgccuggaaggugagcugcacgauccucgcggccguguccgucagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgugauggccgucggcauggugagcauccuggccuccagccugcucaagaacgacauccccaugaccgggccccugguggccggcgggcugcucacggucugcuacgugcugaccggccggagcgcggaccuggagcucgagcgcgccgccgacgugaagugggaggaccaggccgagaucuccgggagcucccccauccugagcaucaccaucuccgaggacggcagcauguccaucaagaacgaggaggaggagcacacccugacgauccucauccggaccggccugcuggucaucagcgggguguucccgguguccauccccaucaccgccgcggccugguaccucugggaggucaagaagcagcgcgccggcgugcugugggacgugcccagcccgccgcccgucgggaaggccgagcuggaggacggcgccuaccggaucaagcagcgcgggaucuucggcuacucccagaucggcgcggggguguacaaggagggcaccuuccacaccauguggcacgugacgcgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgccgugcagaccaagcccggccuguucaagaccaacaccgggacgaucggcgcggugagccucgacuucucccccggcaccagcgggucccccaucgucgaccggaagggcaaggugguggggcuguacggcaacggcgucgugacccgcagcggggccuacguguccgccaucgcccagaccgagaaguccaucgaggacaaccccgagaucgaggacgacaucuuccggaagaagcgccugacgaucauggaccuccaccccggcgcggggaagaccaagcgguaccugcccgccaucguccgcgaggccaucaagcggggccugcgcacccugauccucgccccgacccgcgugguggccgcggagauggaggaggcccugcgggggcugcccauccgcuaccagacgcccgccauccgggccgagcacaccggccgcgagaucgucgaccucaugugccacgccaccuucaccaugcggcugcugagccccgugcgcgugccgaacuacaaccucaucaucauggacgaggcgcacuucacggaccccgccuccaucgccgcccggggcuacaucagcacccgcgucgagaugggggaggccgcgggcaucuucaugaccgccacgccgcccgggucccgggacccguucccccagagcaacgcccccaucauggacgaggagcgcgagauccccgagcgguccuggaacagcggccacgagugggugacggacuucaaggggaagaccgugugguucgucccguccaucaaggccggcaacgacaucgcggccugccugcgcaagaacggcaagaaggugauccagcugagccggaagaccuucgacuccgaguacgugaagacccgcgccaacgacugggacuucgucgugacgaccgacaucagcgagaugggggccaacuuccgggccgagcgcgugaucgacccccggcgcugcaugaagcccgucauccucaccgacggcgaggagcgggugauccuggcggggcccaugccggugacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuaccgggucgccgccgagggcaucaacuacgcggaccgccgguggugcuucgacgggaucaagaacaaccagauccucgaggagaacguggagguggagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaaggcccgggacgcccucgacaaccuggccguccugcacaccgccgaggugggcgggcgcgcguacaaccacgcccucagcgagcugcccgagacgcuggagacccuccugcugcucacccugcuggccaccgucacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacguggucaucgccauccugacggugguggccgccaccauggcgaacgagaugggguuccuggagaagaccaagaaggaccucggccugggcagcaucaccacgcaggagagcgaguccaacauccuggacaucgaccuccgcccggccagcgccuggacccuguacgccgucgccaccaccuucgugacgcccaugcugcggcacuccaucgagaacagcuccgugaacgucagccucaccgcgaucgccaaccaggccaccgugcugauggggcugggccgcggguggccccucuccaagauggacaucggcgugccccugcuggccaucgggugcuacagccaggucaacccgaucacccucacggcggcccugcugcuccugguggcccacuacgccaucaucggccccggccugcaggccaaggcgacccgcgaggcccagaagcggaccgccgccgggaucaugaagaaccccaccguggacggcaucacggucaucgaccucgagcccaucccguacgaccccaaguucgagaagcagcugggccaggugaugcugcucgugcugugcgucacccaggugcugaugaugcgcaccaccugggcccucugcgaggcgcugacgcuggccaccggccccaucuccacccucugggaggggaaccccggccgguucuggaacaccacgaucgccgugagcauggccaacaucuuccgcggcuccuaccuggccggggcgggccuccuguucagcaucaugaagaacaccaccaacacccggcgcgggacgggcaacaucggcgagacccugggggagaaguggaagucccggcugaacgcccucggcaagagcgaguuccagaucuacaagaaguccgggauccaggaggucgaccgcacccuggccaaggagggcaucaagcgcggggagaccgaccaccacgccgugagccgcggcuccgcgaagcugcggugguucguggagcgcaacauggucacgccggagggcaaggugguggaccucgggugcggccgcggcggguggagcuacuacugcggcgggcugaagaacguccgcgaggugaaggggcugaccaagggcggccccgggcacgaggagcccauccccauguccaccuacggcuggaaccucgugcggcugcagagcggggucgacguguucuucaccccgcccgagaagugcgacacgcugcucugcgacaucggcgagagcucccccaaccccaccguggaggccggccgcacccugcggguccugaaccucguggagaacuggcugaacaacaacacccaguucugcgugaagguccugaacccguacaugcccagcgugaucgagaagauggaggcccuccagcgcaaguacgggggcgcccuggugcggaacccccugucccgcaacagcacccacgagauguacugggucuccaacgccacggggaacaucgugagcuccgugaacaugaucagccgcaugcugaucaaccgguucaccaugaagcacaagaaggcgaccuacgagccggacgucgaccucggcuccgggacccgcaacaucggcaucgagagcgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacgggguggucaagcugcucacgaagcccugggacguggugccgauggucacccagauggccaugaccgacaccacgcccuucggccagcagcgcguguucaaggagaagguggacacccggacccaggagcccaaggagggcaccaagaagcugaugcgcaucacggccgaguggcuguggaaggagcucgggcggaagaagacgccccggaugugcacccgggaggaguucacccgcaagguccggagcaacgcggcccugggcgccaucuucacggacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggcgcgauguacgccgacgacaccgccgggugggacacccggaucacgcuggaggaccucaagaacgaggagauggugaccaaccacaugaagggcgagcacaagaagcuggccgaggccaucuucaagcugaccuaccagaacaaggugguccgcgugcagcgcccgacgccccgggggacggugauggacaucaucucccgcaaggaccagcggggcagcggccaggucgggaccuacggccucaacaccuucaccaacauggaggcgcagcugauccgccagauggagggggagggcaucuucaaguccauccagcggcugacggugaccgaggagaucgccgugcagaacuggcucgcccgcgucggccgggagcgccugagccggauggccaucuccggggacgacugcguggugaagccccuggacgaccgcuucgccagcgcgcucaccgcccugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagacggccugccucgggaaguccuacgcgcagauguggacccugauguacuuccaccggcgcgaccugcggcucgccgccaacgccaucugcagcgccguccccucccacugggugcccaccagccgcaccaccugguccauccacgcgaagcacgaguggaugacgaccgaggacaugcuggccguguggaaccgcgucuggauccaggagaacccguggauggaggacaagacccccguggagagcugggaggaggugcccuaccugggcaagcgggaggaccaguggugcgggagccucaucggccugaccucccgcgccacgugggccaagaacauccagaccgcgaucaaccagguccggagccugaucgggaacgaggaguacaccgacuacaugcccuccaugaagcgcuuccggaaggaggaggaggaggccggcgugcucugguga

SEQ ID NO: 9443 - RNA, 9876 nt, Artificial Sequence
  derived and/or modified CDS sequence (opt1) from DENV-2__EU482720__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaccauggccgcgauccuggccuacaccaucgggacgacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacacgaucgugaucacgccccacagcggggaggagcacgccgucggcaacgacaccgggaagcacggcaaggagaucaagaucaccccgcaguccagcaucaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccucgagaagcggcacguccuggggcgccugaucaccgugaacccgaucgcgaccgagaaggacagccccgugaacaucgaggccgagccgcccuucggcgacuccuacaucaucaucggggucgagccgggccagcucaagcugaacugguucaagaaggggagcuccaucggccagauguucgagacgaccaugcgcggcgccaagcggauggccauccugggggacaccgccugggacuucggcagccucgggggcguguucaccuccaucgggaaggcgcugcaccagguguucggcgccaucuacggcgccgccuucagcggggucuccuggacgaugaagauccugaucggcgugaucaucaccuggaucgggaugaacagccgcuccaccagccuguccgugagccucguccuggugggcaucgugacccuguaccucggggucauggugcaggcggacacgggcugcguggucuccuggaagaacaaggagcugaagugcggcagcgggaucuucaucaccgacaacgugcacaccuggaccgagcaguacaaguuccagcccgagucccccagcaagcuggccagcgccauccagaaggcccacgaggagggcaucugcgggauccgguccgugacgcgccucgagaaccugauguggaagcagaucacccccgagcugaaccacauccucagcgagaacgaggucaagcugaccaucaugaccggcgacaucaaggggaucaugcaggccggcaagcggucccugcgcccgcagcccacggagcucaaguacagcuggaagaccuggggcaaggcgaagaugcuguccaccgagagccacaaccagaccuuccugaucgacgggcccgagacggccgagugcccgaacaccaaccgggccuggaacucccucgagguggaggacuacggcuucgggguguucagcaccaacaucuggcugaagcugcgcgagaagcaggacgucuucugcgacuccaagcucaugagcgccgccaucaaggacaaccgggcggugcacgccgacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgucucccagcacaacuaccgcccgggcuaccacacgcagaccgcggggcccuggcaccugggcaagcuggagauggacuucgacuucugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcacgaagcacgcgauccuccugguggccgucagcuucgugacccugaucaccgggaacauguccuuccgggaccucggccgcgugauggucauggugggggccaccaugacggacgacaucggcaugggcgugaccuaccuggcccugcucgccgcguucaagguccgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugauggugcucaagaucgugcgcaacauggagaaguaccagcuggccgucacgaucauggccaucuccugcgugccgaacgccgugauccugcagaacgcguggaaggucagcugcaccauccucgccgccguguccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccgucauggccgugggcauggucagcauccuggccuccagccugcucaagaacgacauccccaugacggggccccugguggcgggcgggcugcucaccgugugcuacguccugaccggccggagcgccgaccuggagcucgagaaggccgccgacgugaagugggaggaccaggccgagaucuccgggagcucccccauccugagcaucaccaucuccgaggacggcagcauguccaucaagaacgaggaggaggagcacacgcugaccauccucauccgcaccggccugcuggugaucagcggggucuucccgguguccauccccaucaccgcggccgccugguaccucugggaggugaagaagcagcgggccggcguccugugggacgugcccagcccgccgcccguggggaaggccgagcuggaggacggcgcguaccgcaucaagcagcgggggaucuucggcuacucccagaucggcgccggggucuacaaggagggcaccuuccacacgauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagaccaacacggggaccaucggcgccgugagccucgacuucucccccggcaccagcgggucccccaucguggaccgcaagggcaaggucguggggcuguacggcaacggcguggucacccggagcggggccuacguguccgccaucgcgcagacggagaaguccaucgaggacaaccccgagaucgaggacgacaucuuccgcaagaagcggcugaccaucauggaccuccaccccggcgccgggaagaccaagcgcuaccugcccgccaucgugcgggaggccaucaagcgcggccugcggacccugauccucgccccgacgcgcgucguggcggccgagauggaggaggcccugcgcgggcugcccauccgguaccagacccccgccauccgcgccgagcacaccggccgggagaucguggaccucaugugccacgcgaccuucacgaugcgccugcugagccccguccgggugccgaacuacaaccucaucaucauggacgaggcccacuucaccgaccccgccuccaucgccgcccgcggcuacaucagcacccggguggagaugggggaggcggccggcaucuucaugaccgccacgccgcccgggucccgcgacccguucccccagagcaacgcccccaucauggacgaggagcgggagauccccgagcgcuccuggaacagcggccacgagugggucaccgacuucaaggggaagaccgugugguucgugccguccaucaaggcgggcaacgacaucgccgccugccugcggaagaacggcaagaaggucauccagcugagccgcaagaccuucgacuccgaguacgugaagacgcgggccaacgacugggacuucguggucaccaccgacaucagcgagaugggggccaacuuccgcgcggagcgggugaucgacccccgccggugcaugaagcccgugauccucaccgacggcgaggagcgcgucauccuggccgggcccaugccggugacgcacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuaccgcguggccgcggagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcccggacguacagcgacccccucgcccugaaggaguucaaggaguucgcggccggccgcaagucccugacccucaaccugaucaccgagauggggcggcugcccaccuucaugacgcagaaggcccgcgacgcccucgacaaccuggccgugcugcacaccgcggaggucggcgggcgggccuacaaccacgcccucagcgagcugcccgagacccuggagacccuccugcugcucacgcugcuggccaccgugaccggcggcaucuuccucuuccugauguccgggaagggcaucgggaagaugacccugggcaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucaccuacguggugaucgccauccugaccgucguggccgcgaccauggccaacgagaugggguuccuggagaagacgaagaaggaccucggccugggcagcaucaccacccaggagagcgaguccaacauccuggacaucgaccuccggccggccagcgccuggacccuguacgccguggcgacgaccuucgucacccccaugcugcgccacuccaucgagaacagcuccgugaacgugagccucaccgccaucgccaaccaggccacgguccugauggggcugggccggggguggccccucuccaagauggacaucggcgugccccugcuggcgaucgggugcuacagccaggugaacccgaucacccucaccgccgcccugcugcuccuggucgcccacuacgccaucaucggccccggccugcaggcgaaggccacccgcgaggcccagaagcgcacggccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcggacgaccugggcgcucugcgaggcccugacccuggccaccggccccaucuccacgcucugggaggggaaccccggccgcuucuggaacaccaccaucgccgugagcauggccaacaucuuccggggcuccuaccuggcgggggccggccuccucuucagcaucaugaagaacaccacgaacacccgccgggggaccggcaacaucggcgagacccugggggagaaguggaagucccgccugaacgcccucggcaagagcgaguuccagaucuacaagaaguccgggauccaggagguggaccggacgcuggccaaggagggcaucaagcgcggggagaccgaccaccacgcggucagccggggcuccgccaagcugcgcugguucguggagcggaacauggugaccccggagggcaaggucguggaccucgggugcggccgcgggggcuggagcuacuacugcgggggccugaagaacgugcgggaggucaagggccugaccaagggcgggcccgggcacgaggagcccauccccauguccacguacggcuggaaccucgugcgccugcagagcgggguggacgucuucuucaccccgcccgagaagugcgacacccugcucugcgacaucggcgagagcucccccaaccccaccaucgaggccggccggacccugcgcgugcugaaccucguggagaacuggcugaacaacaacacgcaguucugcgucaaggugcugaacccguacaugcccagcgugaucgagaagauggagacccuccagcggaaguacgggggcgcccugguccgcaacccccugucccggaacagcacccacgagauguacuggguguccaacgccaccgggaacaucgugagcuccgucaacaugaucagccgcaugcugaucaaccgcuucacgaugaagcacaagaaggcgaccuacgagccggacguggaccucggcuccgggacccggaacaucggcaucgagaacgagauccccaaccuggacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggugaacggggucgugaagcugcucaccaagcccugggacguggucccgauggugacgcagauggccaugaccgacaccacccccuucggccagcagcggguguucaaggagaaggucgacacgcgcacccaggagcccaaggagggcaccaagaagcugaugcggaucaccgccgaguggcuguggaaggagcucgggaagaagaagacgccccgcaugugcacccgggaggaguucacccgcaaggugcgguccaacgcggcccugggcgccaucuucaccgacgagaacaaguggaaguccgcccgcgaggccguggaggacucccgguucugggagcuggucgaccgcgagcggaaccuccaccuggaggggaagugcgagacgugcguguacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggggaacagccugagcggcgucgagggggagggccugcacaagcucggcuacauccugcgcgacguguccaagaaggagggcggggcgauguacgccgacgacaccgccgggugggacacccggaucacccuggaggaccucaagaacgaggagauggugacgaaccacaugaagggcgagcacaagaagcuggccgaggccaucuucaagcugaccuaccagaacaaggucgugcgcgugcagcggccgacgccccgcgggaccgucauggacaucaucagccgcaaggaccagcggggcuccggccagguggggacguacggccucaacaccuucaccaacauggaggcgcagcugauccgccagauggagggggagggcaucuucaagagcauccagcggcugaccgugacggaggagaucgccguccagaacuggcucgcccgcgugggccgggagcgccugucccggauggccaucagcggggacgacugcguggucaagccccuggacgaccgcuucgccuccgcgcucaccgcccugaacgacaugggcaaggugcggaaggacauccagcagugggagcccagccgcggguggaacgacuggacccaggugccguucugcucccaccacuuccacgagcuggucaugaaggacggccggaugcucguggugcccugccgcaaccaggacgagcugaucgggcgggcccgcaucagccagggcgccggcuggucccugaaggagaccgccugccucggcaagagcuacgcgcagauguggacccugauguacuuccaccggcgcgaccugcggcucgccgccaacgccaucugcuccgccguccccagccacugggugcccacgucccgcaccaccuggagcauccacgcgaagcacgaguggaugaccacggaggacaugcuggccguguggaaccgggucuggauccaggagaacccguggauggaggacaagacccccguggaguccugggaggaggugcccuaccugggcaagcgcgaggaccaguggugcgggagccucaucggccugaccagccgcgccaccugggccaagaacauccagacggcgaucaaccagguccggucccugaucgggaacgaggaguacaccgacuacaugcccagcaugaagcgcuuccggaaggaggaggaggaggccggcgugcucugguga

SEQ ID NO: 9444 - RNA, 9876 nt, Artificial Sequence
  derived and/or modified CDS sequence (opt1) from DENV-2__EU482721__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaccauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucacgaccauggccaagaacaagcccacccuggacuucgagcugaucaagaccgaggccaagcagcccgccacgcuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacacgaucgugaucacgccccacagcggggaggagcacgccgucggcaacgacaccgggaagcacggcaaggagaucaagaucaccccgcaguccagcaucaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcgggguguucaccuccaucgggaaggcccuccaccaggucuucggggcgaucuacggcgccgccuucagcgggguguccuggacgaugaagauccugaucggcgugaucaucaccuggaucgggaugaacagccgcuccaccagccuguccgucagccuggugcucgugggcaucgucacccuguaccugggggugauggugcaggccgacacgggcugcgucguguccuggaagaacaaggagcucaagugcggcagcgggaucuucaucaccgacaacgugcacaccuggaccgagcaguacaaguuccagcccgagucccccagcaagcuggcgagcgccauccagaaggcccacgaggagggcaucugcgggauccgguccgucacgcgccuggagaaccucauguggaagcagaucacccccgagcugaaccacauccugagcgagaacgaggugaagcucaccaucaugaccggcgacaucaaggggaucaugcaggccggcaagcggucccugcgcccgcagcccacggagcugaaguacagcuggaagaccuggggcaaggccaagaugcucuccaccgagagccacaaccagaccuuccugaucgacgggcccgagacggcggagugcccgaacaccaaccgggccuggaacucccuggagguggaggacuacggcuucggggucuucagcaccaacaucuggcucaagcugcgcgagaagcaggacguguucugcgacuccaagcugaugagcgccgccaucaaggacaaccgggccgugcacgcggacaugggcuacuggaucgaguccgcccucaacgacaccuggaagauggagaaggccagcuucaucgagaucaaguccugccacuggcccaagagccacacccugugguccaacggcguccuggagagcgagaugaucauccccaagaacuucgccgggcccgugucccagcacaacuaccgcccgggcuaccacacgcagaccgccgggcccuggcaccucggcaagcuggagauggacuucgacuucugcgaggggaccaccguggucgugacggaggacugcggcaaccggggccccagccugcgcaccaccaccgcgagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcaucggcacgaagcacgccauccugcucguggcggucagcuucgugacccugaucaccgggaacauguccuuccgggaccugggccgcgugauggucauggugggggccaccaugacggacgacaucggcaugggcgugaccuaccucgcccugcuggccgccuucaagguccgccccaccuucgcggccgggcuccugcugcggaagcucaccagcaaggagcugaugauggccacgaucggcaucgcccugcucucccagagcaccauccccgagaccauccuggagcugaccgacgcccucgcgcuggggaugauggugcugaagaucgugcgcaacauggagaaguaccagcucgccgucacgaucauggccaucuccugcgugccgaacgccgugauccugcagaacgccuggaaggucagcugcaccauccuggcggccguguccgugagcccccuccugcugaccuccagccagcagaaggccgacuggaucccccucgcccugaccaucaagggccugaaccccacggcgaucuuccucaccacccugucccggaccagcaagaagcgcuccuggccgcugaacgaggccaucauggccgucggcauggugagcauccucgccuccagccugcugaagaacgacauccccaugacggggccccucgucgccggcgggcugcugaccgugugcuacgugcucaccggccggagcgcggaccuggagcuggagcgcgccgccgacgucaagugggaggaccaggccgagaucuccgggagcucccccauccucagcaucaccaucuccgaggacggcagcauguccaucaagaacgaggaggaggagcacacgcugaccauccugauccggaccggccuccuggugaucagcgggguguucccggucuccauccccaucaccgccgcggccugguaccugugggaggugaagaagcagcgcgccggcgugcucugggacguccccagcccgccgcccguggggaaggccgagcuggaggacggcgccuaccggaucaagcagcgcgggaucuucggcuacucccagaucggcgcggggguguacaaggagggcaccuuccacacgauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcccucgagcccgggaagaacccccgcgccgugcagaccaagcccggccuguucaagaccaacacggggaccaucggcgcggucagccuggacuucucccccggcaccagcgggucccccaucguggaccggaagggcaagguggucgggcucuacggcaacggcguggugacccgcagcggggccuacgucuccgccaucgcccagacggagaaguccaucgaggacaaccccgagaucgaggacgacaucuuccggaagaagcgccugaccaucauggaccugcaccccggcgcggggaagaccaagcgguaccuccccgccaucgugcgcgaggccaucaagcggggccugcgcacccugauccuggccccgacgcgcguggucgccgcggagauggaggaggcccuccgggggcugcccauccgcuaccagacccccgccauccgggccgagcacaccggccgcgagaucguggaccugaugugccacgccaccuucacgaugcggcuccugagccccgugcgcgucccgaacuacaaccugaucaucauggacgaggcgcacuucaccgaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgucugguucgugccguccaucaaggccggcaacgacaucgcggccugccuccgcaagaacggcaagaaggugauccagcugagccggaagaccuucgacuccgaguacgucaagacgcgcgccaacgacugggacuucguggugaccaccgacaucagcgagaugggggccaacuuccgggccgagcgcgucaucgacccccggcgcugcaugaagcccgugauccugaccgacggcgaggagcgggugauccucgcggggcccaugccggucacgcacuccagcgccgcccagcgccgcggccggaucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaagguggacgcgaucgacggggaguaccgccugcggggcgaggcccgcaagaccuucguggaccugaugcggcgcggggaccuccccgucuggcuggccuaccggguggccgccgagggcaucaacuacgcggaccgccgguggugcuucgacgggaucaagaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgccgcgggccggaagucccugacgcugaaccucaucaccgagauggggcgccugcccaccuucaugacccagaaggcccgggacgcccuggacaaccucgccgugcugcacacggccgaggcgggcgggcgcgccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgccagcauccugcucugguacgcgcagauccagccgcacuggaucgccgccuccaucauccuggaguucuuccugaucguccuccugauccccgagcccgagaagcagcggacgccccaggacaaccagcugacguacguggucaucgccauccucaccgugguggccgcgaccauggccaacgagaugggguuccuggagaagaccaagaaggaccugggccucggcagcaucacgacccaggagagcgaguccaacauccuggacaucgaccugcgcccggccagcgccuggacccucuacgccgucgcgaccacguucgugacccccaugcugcggcacuccaucgagaacagcuccgugaacgucagccugaccgccaucgccaaccaggccaccgugcucauggggcugggcaagggguggccccuguccaagauggacaucggcgugccccuccuggcgaucgggugcuacagccaggucaacccgaucacgcugaccgccgcccuccugcugcucguggcccacuacgccaucaucggccccggccugcaggcgaaggccacccgcgaggcccagaagcgcgccgccgcggggaucaugaagaaccccaccguggacggcaucacggucaucgaccuggagcccaucccguacgaccccaaguucgagaagcagcucggccaggugaugcugcugauccucugcgugacccagguccugaugaugcggaccaccugggcccugugcgaggcccucacgcuggccaccggccccaucuccacccugugggaggggaaccccggccgcuucuggaacaccacgaucgccgugagcauggcgaacaucuuccggggcuccuaccucgccggggccggccugcuguucagcaucaugaagaacaccaccaacacccgccgggggacgggcaacaucggcgagacccucggggagaaguggaagucccgccugaacgcccugggcaagagcgaguuccagaucuacaagaaguccgggauccaggagguggaccggacccucgcgaaggagggcaucaagcgcggggagaccgaccaccacgccgucagccggggcuccgccaagcugcgcugguucguggagcggaacauggugacgccggagggcaaggucguggaccuggggugcggccgcgggggcuggagcuacuacugcgggggccucaagaacgugcgggaggucaagggccugaccaagggcggccccgggcacgaggagcccauccccauguccaccuacggcuggaaccuggugcgccuccagagcgggguggacgucuucuucaccccgcccgagaagugcgacacgcugcugugcgacaucggcgagagcucccccaaccccaccaucgaggccggccggacccuccgcgugcugaaccugguggagaacuggcucaacaacaacacccaguucugcaucaagguccugaacccguacaugcccagcgugaucgagaagauggaggcccugcagcggaaguacgggggcgcgcucgugcgcaacccccugucccggaacagcacccacgagauguacugggucuccaacgccacggggaacaucgugagcuccgugaacaugaucagccgcaugcugaucaaccgcuucaccaugaagcacaagaaggccaccuacgagccggacgucgaccugggcuccgggacccggaacaucggcaucgagagcgagauccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggugguccggcugcugacgaagcccugggacguggugccgauggucacccagauggcgaugaccgacaccacgcccuucggccagcagcgcguguucaaggagaagguggacacccggacccaggagcccaaggagggcaccaagaagcucaugaagaucacggccgaguggcuguggaaggagcuggggaagaagaagacgccccgcaugugcacccgggaggaguucacccgcaagguccggagcaacgccgcccucggcgccaucuucacggacgagaacaaguggaaguccgcgcgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacguguccaagaaggagggcggggccauguacgccgacgacaccgccggcugggacacccgcaucacgcuggaggaccugaagaacgaggagauggucaccaaccacaugaagggggagcacaagaagcucgcggaggccaucuucaagcugaccuaccagaacaaggugguccgggugcagcgcccgacgccccgcggcacggugauggacaucaucagccggaaggaccagcgcggcuccgggcaggucggcaccuacgggcugaacaccuucaccaacauggaggcccagcucauccggcagauggagggcgagggcaucuucaagagcauccagcgccugacggugaccgaggagaucgccgugcagaacuggcuggcccgggucgggcgcgagcggcucucccgcauggcgaucagcggcgacgacugcguggugaagccccuggacgaccgguucgccuccgcccugaccgcccucaacgacauggggaagguccgcaaggacauccagcagugggagcccagccggggcuggaacgacuggacccaggugccguucugcucccaccacuuccacgagcuggugaugaaggacgggcgcaugcuggucgugcccugccggaaccaggacgagcucaucggccgcgcccggaucagccagggcgcgggguggucccugaaggagacggccugccugggcaagagcuacgcccagauguggacccucauguacuuccaccgccgggaccugcgccuggccgccaacgcgaucugcuccgccgugcccagccacuggguccccaccucccggaccaccuggagcauccacgccaagcacgaguggaugacgaccgaggacaugcucgccguguggaaccgcguguggauccaggagaacccguggauggaggacaagacccccgucgaguccugggaggaggugcccuaccuggggaagcgcgaggaccaguggugcggcagccugaucgggcucaccagccgggcgacgugggccaagaacauccagaccgccaucaaccaggugcgcucccugaucggcaacgaggaguacaccgacuacaugcccagcaugaagcgguuccgcaaggaggaggaggaggccggcguccugugguga

SEQ ID NO: 9445 - RNA, 9876 nt, Artificial Sequence
  derived and/or modified CDS sequence (opt1) from DENV-2__EU482722__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggucaacucccucgugacggccgggcacggccagaucgacaacuucagccugggcgugcuggggauggcccucuuccuggaggagaugcugcggacccgcgucggcaccaagcacgccauccuccugguggcgguguccuucgucacccugaucacggggaacaugagcuuccgggaccucggccgcgugauggugauggucggggccaccaugaccgacgacaucggcaugggcgugaccuaccuggcccugcucgccgccuucaaggugcgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugacgggccgguccgcggaccuggagcucgagcgcgucgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgccgcgugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgccggggucuacaaggagggcaccuuccacaccauguggcacgugacccgcggggcggugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgccgugucccucgacuucagccccggcacguccgggagccccaucguggaccggaagggcaaggucguggggcuguacggcaacggcguggucacccgcuccggggcguacgugagcgccaucgcccagaccgagaaguccaucgaggacaaccccgagaucgaggacgacaucuuccggaagaagcgccugaccaucauggaccuccaccccggcgccgggaagacgaagcgguaccugcccgcgaucgugcgcgaggccaucaagcggggccugcgcacccugauccucgccccgacccgcgucguggccgccgagauggaggaggcgcugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcccacuucaccgaccccgcgagcaucgccgcccggggcuacaucuccacgcgcguggagaugggggaggccgccggcaucuucaugaccgcgacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgccgcgugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggccgggcccaugccggugacccacagcuccgcggcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgccaucgacggggaguaccgccugcggggcgaggcgcgcaagacguucgucgaccucaugcggcgcggggaccugcccguguggcuggccuaccggguggccgccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcgcgcaucuacuccgacccccucgcccugaaggaguucaaggaguucgccgccggccggaagacccugacccucaaccugaucacggagauggggcgccugcccaccuucaugacccagaaggcgcgggacgcccucgacaaccuggccguccugcacaccgccgaggugggcgggcgcgccuacaaccacgcgcucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgccgcguccaucauccuggaguucuuccucaucguccugcugauccccgagcccgagaagcagcggacgccccaggacaaccagcucaccuacguggugaucgccauccugacggucguggccgccaccauggccaacgagaugggguuccuggagaagaccaagaaggaccucggccugggcagcaucaccacgcaggagagcgaguccaacauccuggacaucgaccuccgcccggcgagcgccuggacccuguacgccguggccaccaccuucgucacgcccaugcugcggcacuccaucgagaacagcuccgugaacgugagccucaccgccaucgcgaaccaggccaccguccugauggggcugggccgcggguggccccucuccaagauggacaucggcgugccccugcuggccaucgggugcuacagccaggugaacccgaucacccucacggccgcgcugcugcuccuggucgcccacuacgccaucaucggccccggccugcaggccaaggccacccgcgaggcgcagaagcggaccgccgccgggaucaugaagaaccccaccguggacggcaucacggugaucgaccucgagcccaucccguacgaccccaaguucgagaagcagcuggggcaggucaugcugcucgugcugugcgugacccagguccugaugaugcgcaccaccugggcccucugcgaggcccugacgcuggcgaccggccccaucuccacccucugggaggggaaccccggccgguucuggaacaccacgaucgccgugagcauggccaacaucuuccgcggcuccuaccuggccggggccggccuccucuucagcaucaugaagaacaccaccaacacccggcgcgggacgggcaacaucggcgagacccugggggagaaguggaagucccggcugaacgcgcucggcaagagcgaguuccagaucuacaagaaguccgggauccaggagguggaccgcacccuggccaaggagggcaucaagcgcggggagaccgaccaccacgccgucagccgcggcuccgccaagcugcggugguucguggagcgcaacauggugacgccggagggcaaggucguggaccucgggugcggccgcggcggguggagcuacuacugcggcgggcugaagaacgugcgcgaggucaaggggcugaccaagggcgggcccgggcacgaggagcccauccccauguccaccuacggcuggaaccucgugcggcugcagagcgggguggacgucuucuucaccccgcccgagaagugcgacacgcugcucugcgacaucggcgagagcucccccaaccccaccaucgaggcgggccgcacccugcgggugcugaaccucguggagaacuggcugaacaacaacacccaguucugcgucaaggugcugaacccguacaugcccagcgugaucgagaagauggagacccuccagcgcaaguacgggggcgcccugguccggaacccccugucccgcaacagcacgcacgagauguacuggguguccaacgccaccgggaacaucgugagcuccgucaacaugaucagccgcaugcugaucaaccgguucaccaugaagcacaagaaggccaccuacgagccggacguggaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggccuaccacggguccuacgagaccaagcagacgggcagcgcguccagcauggugaacggggucgugaagcugcucaccaagcccugggacgugaucccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcccugggcgcgaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgccgacgacaccgcggggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucagccggaaggaccagcgcggcuccggccaggucgggaccuacggccucaacaccuucacgaacauggaggcccagcugauccggcagauggagggggagggcaucuucaagagcauccagcgccugaccgugaccgaggagaucgccgugcagaacuggcucgcgcgggucggccgcgagcggcugucccgcauggccaucagcggggacgacugcguggugaagccccuggacgaccgguucgccuccgcccucaccgcccugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcgcggaucagccagggcgccggcuggucccugaaggagaccgccugccucggcaagagcuacgcccagauguggacccugauguacuuccaccgccgggaccugcgccucgccgcgaacgccaucugcuccgccguccccagccacugggugcccaccucccggaccacguggagcauccacgccaagcacgaguggaugaccaccgaggacaugcuggccguguggaaccgcgucuggauccaggagaacccguggauggaggacaagacccccguggaguccugggaggaggugcccuaccugggcaagcgcgaggaccaguggugcgggagccucaucggccugacgagccgggcgaccugggccaagaacauccagaccgccaucaaccagguccgcucccugaucgggaacgaggaguacaccgacuacaugcccagcaugaagcgguuccgcaaggaggaggaggaggccggcgugcucugguga

SEQ ID NO: 9446 - RNA, 9876 nt, Artificial Sequence
  derived and/or modified CDS sequence (opt1) from DENV-2__EU482723__SS-prME
accgccggcgugaucaucaugcugauccccaccgccauggcguuccaccucaccacccgcaacggggagccccacaugaucgucggccggcaggagaagggcaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagcgggccuggaagcacguccagcgcaucgagaccuggauccugcggcacccgggguucaccaucauggccgcgauccuggccuacaccaucggcaccacgcacuuccagcgcgcccucaucuucauccugcugaccgccguggcgcccagcaugaccaugcggugcaucgggaucuccaaccgcgacuucguggagggcgucagcggcggguccuggguggacaucgugcucgagcacggcagcugcgucaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggggagcccagccugaacgaggagcaggacaagcgguucaucugcaagcacuccaugguggaccgcggcuggggcaacgggugcggccucuucgggaagggcgggaucgugaccugcgcgauguucacgugcaagaagaacauggagggcaaggucgugcugcccgagaaccuggaguacaccaucgugaucacgccccacagcggcgaggagcacgccgucgggaacgacaccggcaagcacgggaaggagaucaagaucaccccgcaguccagcaucaccgaggccgagcucaccggcuacgggacggugaccauggagugcagcccccggaccggccuggacuucaacgagauggugcugcuccagauggaggacaaggccuggcugguccaccgccagugguuccuggaccucccccugcccuggcugccgggcgccgacacccaggggagcaacuggauccagaaggagacgcucgugaccuucaagaacccccacgcgaagaagcaggacguggucgugcugggcucccaggagggggccaugcacaccgcccugaccggcgccacggagauccagaugagcagcgggaaccuccuguucaccggccaccugaagugccggcuccgcauggacaagcugcagcugaagggcauguccuacagcaugugcaccgggaaguucaagaucgucaaggagaucgccgagacccagcacggcacgaucgugauccgggugcaguacgagggggacggcucccccugcaagauccccuucgagaucauggaccucgagaagcgccacguccugggccgccugaucaccgugaacccgaucgugaccgagaaggacagccccgucaacaucgaggcggagccgcccuucggggacuccuacaucaucaucggcguggagccggggcagcucaagcugaacugguucaagaagggcagcuccaucgggcagauguucgagaccacgaugcggggcgccaagcgcauggccauccugggcgacaccgccugggacuucgggagccucggcgggguguucaccuccaucggcaaggcccugcaccaggucuucggggcgaucuacggcgccgccuucagcggcguguccuggaccaugaagauccugaucggggugaucaucacguggaucggcaugaacagccgguccaccagccuguccgucagccucgugcuggugggggucgugacccuguaccucggcgugaugguccaggccgacuccgggugcguggugagcuggaagaacaaggagcugaagugcggcuccggcaucuucaucaccgacaacguccacacguggaccgagcaguacaaguuccagcccgagagccccagcaagcuggcguccgccauccagaaggcccacgaggaggggaucugcggcauccgcagcgugacccggcucgagaaccugauguggaagcagaucacccccgagcugaaccacauccucuccgagaacgaggugaagcugacgaucaugaccggggacaucaagggcaucaugcaggccgggaagcgcagccugcggccgcagcccaccgagcucaaguacuccuggaagaccuggggcaaggccaagaugcugagcacggagucccacaaccagaccuuccugaucgacggccccgagaccgcggagugcccgaacaccaaccgcgccuggaacagccucgaggucgaggacuacggguucggcguguucuccacgaacaucuggcugaagcugcgggagaagcaggacguguucugcgacagcaagcucauguccgccgccaucaaggacaaccgcgccguccacgcggacaugggguacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccggccccgugagccagcacaacuaccggccgggguaccacacccagaccgccggccccuggcaccuggggaagcuggagauggacuucgacuucugcgagggcacgaccgucguggugaccgaggacugcgggaaccgcggccccagccuccggaccacgaccgcguccggcaagcugaucaccgaguggugcugccgcagcugcacccugcccccgcuccgguaccgcggggaggacggcugcugguacgggauggagauccggccccugaaggagaaggaggagaaccuggucaacucccucgugacggccggccacgggcagaucgacaacuucagccugggcgugcugggcauggcccucuuccuggaggagaugcugcgcacccgggucgggaccaagcacgccauccuccugguggcgguguccuucgucacccugaucacgggcaacaugagcuuccgcgaccucgggcgcgugauggugauggucggcgccaccaugaccgacgacaucgggaugggcgugaccuaccuggcccugcucgccgccuucaaggugcggcccacguucgcggccggccugcugcuccgcaagcugaccuccaaggagcugaugauggccaccaucgggaucgcccuccugagccaguccaccauccccgagacgauccuggagcucaccgacgcccuggcgcugggcaugaugguccucaagaucgugcggaacauggagaaguaccagcuggccgugaccaucauggccaucagcugcgucccgaacgccgugauccugcagaacgccuggaagguguccugcaccauccucgcggccgucagcgugagcccccugcugcucacgagcucccagcagaaggccgacuggaucccccuggcccugaccaucaaggggcucaaccccaccgcgaucuuccugaccacgcugagccgcaccuccaagaagcggagcuggccgcucaacgaggccgucauggccgugggcaugguguccauccuggccagcagccugcucaagaacgacauccccaugaccggcccccuggucgccgggggccugcucaccgugugcuacgugcugacggggcgcuccgcggaccuggagcucgagcgggccgccgacgucaagugggaggaccaggccgagaucagcggcuccagccccauccuguccaucaccaucagcgaggacggguccaugagcaucaagaacgaggaggaggagcacacccugaccauccucauccgcacgggccugcuggugaucuccggcguguucccggucagcauccccaucaccgccgcggccugguaccucugggaggugaagaagcagcgggccggggugcugugggacguccccagcccgccgcccgugggcaaggccgagcuggaggacggggccuaccgcaucaagcagcggggcaucuucggguacagccagaucggcgcgggcguguacaaggaggggaccuuccacaccauguggcacgucacccgcggcgccgugcucaugcaccgggggaagcgcaucgagcccuccugggccgacgugaagaaggaccugaucagcuacggcgggggcuggaagcuggagggcgaguggaaggagggggaggagguccaggugcucgcccuggagcccggcaagaacccccgggccgugcagacgaagcccgggcuguucaagaccaacaccggcaccaucggggcggucucccucgacuucagccccggcacguccggcagccccaucguggaccgcaaggggaagguggucggccuguacgggaacggcguggugacccgguccggcgccuacgucagcgccaucgcccagaccgagaaguccaucgaggacaaccccgagaucgaggacgacaucuuccgcaagaagcggcugaccaucauggaccuccaccccggggcgggcaagacgaagcgcuaccugcccgccaucgugcgggaggccaucaagcgcgggcugcgcacccugauccucgccccgacccggguggucgccgcggagauggaggaggcccugcgcggccugcccauccgguaccagacccccgccauccgcgccgagcacacggggcgggagaucguggaccucaugugccacgccaccuucaccaugcgccugcugucccccgugcgggucccgaacuacaaccucaucaucauggacgaggcgcacuucaccgaccccgccagcaucgccgcccgcggcuacaucuccacgcggguggagaugggcgaggccgcggggaucuucaugaccgccacgccgcccggcagccgcgacccguucccccaguccaacgcccccaucauggacgaggagcgggagauccccgagcgcagcuggaacuccgggcacgagugggugaccgacuucaagggcaagacggucugguucgugccgagcaucaaggccgggaacgacaucgcggccugccugcggaagaacggcaagaaggugauccagcugucccgcaagaccuucgacagcgaguacgucaagacccgggccaacgacugggacuucguggugaccacggacaucuccgagaugggcgccaacuuccgcgccgagcgggucaucgacccccgccggugcaugaagcccgugauccucaccgacggggaggagcgcgugauccuggcgggccccaugccggucacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccggaagacguucguggaccucaugcgccggggcgaccugcccgucuggcuggccuaccgcguggccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccacguucaugacccagaaggcccgcgacgcccucgacaaccuggccgugcugcacaccgccgaggucgggggccgggcguacaaccacgcccucuccgagcugcccgagacccuggagacgcuccugcugcucacccugcuggccaccgugaccgggggcaucuuccucuuccugaugagcggcaaggggaucggcaagaugacgcuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccacgauggcgaacgagaugggcuuccuggagaagaccaagaaggaccucgggcugggcagcaucaccacccaggaguccgagagcaacauccuggacaucgaccuccggccggccuccgccuggacgcuguacgccguggccaccaccuucgugacccccaugcugcgccacagcaucgagaacuccagcgucaacgugucccucacggcgaucgccaaccaggccaccgugcugaugggccuggggcgcggcuggccccucagcaagauggacaucggggucccccugcuggccaucggcugcuacucccaggugaacccgaucacccucaccgcggcccugcugcuccugguggcccacuacgccaucaucgggcccggccugcaggccaaggcgacgcgggaggcccagaagcgcaccgccgccggcaucaugaagaaccccaccgucgacgggaucaccgugaucgaccucgagcccaucccguacgaccccaaguucgagaagcagcugggccaggugaugcugcucguccugugcgugacccaggugcugaugaugcggaccaccugggcccucugcgaggcgcugacccuggccacggggcccaucagcacccucugggagggcaaccccgggcgcuucuggaacaccaccaucgccgucuccauggccaacaucuuccggggcagcuaccuggccggcgcggggcuccuguucuccaucaugaagaacacgaccaacacccgccggggcaccgggaacaugggcgagacgcugggcgagaaguggaagucccgccugaacgcccucgggaaguccgaguuccagaucuacaagaaguccggcauccaggagguggaccggacccuggccaaggaggggaucaagcgcggcgagaccgaccaccacgccgugucccgggggagcgcgaagcugcgcugguucgucgagcggaacauggugaccccggagggcaagguggucgaccucggcugcgggcgcggcgggugguccuacuacugcggcgggcugaagaacgugcgggaggugaagggccugacgaagggcgggcccggccacgaggagcccauccccaugagcaccuacggguggaaccucguccgccugcagagcggcguggacguguucuucaccccgcccgagaagugcgacacccugcucugcgacaucggggaguccagccccaaccccacgaucgaggccggccggacccugcgcguccugaaccucguggagaacuggcugaacaacaacacccaguucugcaucaaggugcugaacccguacaugcccuccgucaucgagaagauggagacccuccagcggaaguacggcggggcccuggugcgcaacccccugagccgcaacuccacccacgagauguacugggugagcaacgccacgggcaacaucgucuccagcgugaacaugaucucccggaugcugaucaaccgcuucaccaugaagcacaagaaggccaccuacgagccggacguggaccucgggagcggcacccggaacaucgggaucgagaacgagauccccaaccuggacaucaucggcaagcgcaucgagaagaucaagcaggagcacgagacguccuggcacuacgaccaggaccaccccuacaagaccugggcguaccacggcagcuacgagaccaagcagaccggguccgccagcuccauggucaacggcguggugaagcugcucacgaagcccugggacgucgugccgauggugacccagauggccaugaccgacaccacgcccuucgggcagcagcgggucuucaaggagaagguggacacccgcacccaggagcccaaggagggcaccaagaagcugaugcggaucacggccgaguggcuguggaaggagcucggcaagaagaagacgccccgcaugugcacccgggaggaguucacccgcaaggugcggagcaacgccgcgcugggggccaucuucacggacgagaacaaguggaaguccgcccgcgaggccgucgaggacagccgguucugggagcugguggaccgcgagcggaaccuccaccuggagggcaagugcgagaccugcgucuacaacaugauggggaagcgcgagaagaagcugggcgaguucgggaaggccaagggcucccgggcgaucugguacauguggcucggcgcccgcuuccuggaguucgaggcccugggguuccucaacgaggaccacugguucagccggggcaacagccuguccgggguggagggcgaggggcugcacaagcucggcuacauccugcgcgacgugagcaagaaggagggcggggccauguacgcggacgacaccgccggcugggacacccggaucacgcuggaggaccucaagaacgaggagauggucaccaaccacaugaagggggagcacaagaagcuggccgaggccaucuucaagcugaccuaccagaacaagguggugcgcguccagcgcccgacgccccggggcacggugauggacaucaucucccgcaaggaccagcgggggagcggccaggugggcaccuacgggcucaacaccuucaccaacauggaggcccagcugauccgccagauggagggcgaggggaucuucaaguccauccagcggcugacggucaccgaggagaucgcggugcagaacuggcucgcccgcgugggccgggagcgccugagccggauggccaucuccggcgacgacugcgucgugaagccccuggacgaccgcuucgccagcgcccucaccgcgcugaacgacauggggaaggugcggaaggacauccagcagugggagcccucccgcggcuggaacgacuggacccaggucccguucugcagccaccacuuccacgagcuggugaugaaggacgggcgggugcucgucgugcccugccgcaaccaggacgagcugaucggccgggcccgcaucucccagggggccggcuggagccugaaggagacggccugccucggcaaguccuacgcccagauguggacccugauguacuuccaccggcgcgaccugcggcucgcggccaacgccaucugcagcgccgugcccucccacuggguccccaccagccgcaccaccugguccauccacgccaagcacgaguggaugacgaccgaggacaugcuggcgguguggaaccgcguguggauccaggagaacccguggauggaggacaagacccccgucgagagcugggaggaggugcccuaccuggggaagcgggaggaccaguggugcggcagccucaucgggcugaccucccgcgccacgugggccaagaacauccagaccgccaucaaccaggugcggagccugaucggcaacgaggaguacaccgacuacaugcccuccaugaagcgcuuccggaaggaggaggaggaggcggggguccucugguga

SEQ ID NO: 9447 - RNA, 9876 nt, Artificial Sequence
  derived and/or modified CDS sequence (opt1) from DENV-2__EU482724__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgucccgggccuggaacagccucgaggucgaggacuacggcuucgggguguucuccaccaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgagaucaagagcugccacuggcccaagucccacacccuguggagcaacggcgugcucgaguccgagaugaucauccccaagaacuucgccgggcccgugagccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcguccgggaagcugaucaccgaguggugcugccggagcugcacgcugcccccgcuccgcuaccggggcgaggacgggugcugguacggcauggagauccgcccccugaaggagaaggaggagaaccuggucaacucccucgugaccgccgggcacggccagaucgacaacuucagccugggcgugcuggggauggcccucuuccuggaggagaugcugcggacccgcgucggcaccaagcacgccauccuccugguggcgguguccuucgucacgcugaucaccgggaacaugagcuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccuccaaggagcugaugauggccaccaucggcaucgcccuccugagccaguccacgauccccgagaccauccuggagcucaccgacgcccuggcgcuggggaugaugguccucaagaucgugcgcaacauggagaaguaccagcuggccgugaccaucauggccaucagcugcgucccgaacgccgugauccugcagaacgccuggaagguguccugcacgauccucgcggccgucagcgugagcccccugcugcucaccagcucccagcagaaggccgacuggaucccccuggcccugaccaucaagggccucaaccccaccgcgaucuuccugacgacccugagccggaccuccaagaagcgcagcuggccgcucaacgaggccgucauggccgugggcaugguguccauccuggccagcagccugcucaagaacgacauccccaugaccgggccccuggucgccggcgggcugcucacggugugcuacgugcugaccggccgguccgcggaccuggagcucgagcgcgccgccgacgucaagugggaggaccaggccgagaucagcggguccagccccauccuguccaucaccaucagcgaggacggcuccaugagcaucaagaacgaggaggaggagcacacccugacgauccucauccggaccggccugcuggugaucuccgggguguucccggucagcauccccaucaccgccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacgcgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagaccaagcccggccuguucaagaccaacaccgggacgaucggcgcggucucccucgacuucagccccggcaccuccgggagccccaucguggaccggaagggcaagguggucgggcuguacggcaacggcguggugacccgcuccggggccuacgucagcgccaucgcccagaccgagaaguccaucgaggacaaccccgagaucgaggacgacaucuuccggaagaagcgccugacgaucauggaccuccaccccggcgcggggaagaccaagcgguaccugcccgccaucgugcgcgaggccaucaagcggggccugcgcacccugauccucgccccgacccgcguggucgccgcggagauggaggaggcccugcgggggcugcccauccgcuaccagacgcccgccauccgggccgagcacaccggccgcgagaucguggaccucaugugccacgccaccuucaccaugcggcugcugucccccgugcgcgucccgaacuacaaccucaucaucauggacgaggcgcacuucacggaccccgccagcaucgccgcccggggcuacaucuccacccgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggccggcaacgacaucgcggccugccugcgcaagaacggcaagaaggugauccagcugucccggaagaccuucgacagcgaguacgucaagacccgcgccaacgacugggacuucguggugacgaccgacaucuccgagaugggggccaacuuccgggccgagcgcgucaucgacccccggcgcugcaugaagcccgugauccucaccgacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucacggagauggggcgccugcccaccuucaugacccagaaggcccgggacgcccucgacaaccuggccgugcugcacaccgccgaggucggcgggcgcgcguacaaccacgcccucuccgagcugcccgagacgcuggagacccuccugcugcucacccugcuggccaccgugacgggcggcaucuuccucuuccugaugagcgggaagggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugacgguggucgccgccaccauggcgaacgagaugggguuccuggagaagaccaagaaggaccucggccugggcagcaucaccacgcaggaguccgagagcaacauccuggacaucgaccuccgcccggccuccgccuggacccuguacgccguggccaccaccuucgugacgcccaugcugcggcacagcaucgagaacuccagcgucaacgugucccucaccgcgaucgccaaccaggccaccgugcugauggggcugggccgcggguggccccucagcaagauggacaucggcgucccccugcuggccaucgggugcuacucccaggugaacccgaucacccucacggcggcccugcugcuccugguggcccacuacgccaucaucggccccggccugcaggccaaggcgacccgcgaggcccagaagcggaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcgcaccaccugggcccucugcgaggcgcugacgcuggccaccggccccaucagcacccucugggaggggaaccccggccgguucuggaacaccacgaucgccgucuccauggccaacaucuuccgcggcagcuaccuggccggggcgggccuccucuucuccaucaugaagaacaccaccaacacccggcgcgggacgggcaacaucggcgagacccugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugacgccggagggcaagguggucgaccucgggugcggccgcggcgggugguccuacuacugcggcgggcugaagaacgugcgcgaggugaaggggcugaccaagggcgggcccgggcacgaggagcccauccccaugagcaccuacggcuggaaccucguccggcugcagagcgggguggacguguucuucaccccgcccgagaagugcgacacgcugcucugcgacaucggcgaguccagccccaaccccaccaucgaggccggccgcacccugcggguccugaaccucguggagaacuggcugaacaacaacacccaguucugcgugaagguccugaacccguacaugcccuccgugaucgagaagauggagacccuccagcgcaaguacgggggcgcccuggugcggaacccccugagccgcaacuccacgcacgagauguacugggucagcaacgccaccgggaacaucguguccagcgugaacaugaucucccgcaugcugaucaaccgguucaccaugaagcacaagaaggccaccuacgagccggacgucgaccucggcagcgggacgcgcaacaucggcaucgagaacgagauccccaaccuggacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcagcaacgccgcgcugggcgccaucuucaccgacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucucccggaaggaccagcgcggcagcggccaggucgggaccuacggccucaacaccuucacgaacauggaggcccagcugauccggcagauggagggggagggcaucuucaaguccauccagcgccugaccgugaccgaggagaucgcggugcagaacuggcucgcccgggucggccgcgagcggcugagccgcauggccaucuccggggacgacugcguggugaagccccuggacgaccgguucgccagcgcccucaccgcgcugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagaccgccugccucgggaaguccuacgcccagauguggacccugauguacuuccaccgccgggaccugcgccucgcggccaacgccaucugcagcgccguccccucccacugggugcccaccagccggaccacgugguccauccacgccaagcacgaguggaugaccaccgaggacaugcuggcgguguggaaccgcgucuggauccaggagaacccguggauggaggacaagacccccguggagagcugggaggaggugcccuaccugggcaagcgcgaggaccaguggugcgggagccucaucggccugacgucccgggccaccugggccaagaacauccagaccgccaucaaccagguccgcagccugaucgggaacgaggaguacaccgacuacaugcccuccaugaagcgguuccgcaaggaggaggaggaggcgggcgugcucugguga

SEQ ID NO: 9448 - RNA, 9876 nt, Artificial Sequence
  derived and/or modified CDS sequence (opt1) from DENV-2__EU482725__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacaccggcugcgugguguccuggaagaacaaggagcugaagugcggcagcgggaucuucaucacggacaacguccacaccuggaccgagcaguacaaguuccagcccgagucccccagcaagcuggcgagcgccauccagaaggcccacgaggagggcaucugcgggauccgguccgugacccgccucgagaaccugauguggaagcagaucacgcccgagcugaaccacauccucagcgagaacgaggugaagcugaccaucaugaccggcgacaucaaggggaucaugcaggccggcaagcggucccugcgcccgcagcccaccgagcucaaguacagcuggaagacguggggcaaggccaagaugcuguccaccgagagccacaaccagaccuuccugaucgacgggcccgagaccgcggagugcccgaacacgaaccgggccuggaacucccucgaggucgaggacuacggcuucgggguguucagcaccaacaucuggcugaagcugcgcgagaagcaggacguguucugcgacuccaagcucaugagcgccgccaucaaggacaaccgggccguccacgcggacaugggcuacuggaucgaguccgcccugaacgacaccuggaagauggagaaggccagcuucaucgagaucaaguccugccacuggcccaagagccacacccugugguccaacggcgugcucgagagcgagaugaucauccccaagaacuucgccgggcccgugucccagcacaacuaccgcccgggcuaccacacccagacggccgggcccuggcaccugggcaagcuggagauggacuucgacuucugcgaggggaccaccgucguggugaccgaggacugcggcaaccggggccccagccuccgcacgaccaccgcgagcgggaagcugaucaccgaguggugcugccgguccugcacgcugcccccgcuccgcuaccggggcgaggacgggugcugguacggcauggagauccgcccccugaaggagaaggaggagaaccuggucaacagccucgugaccgccgggcacggccagaucgacaacuucucccugggcgugcuggggauggcccucuuccuggaggagaugcugcggacccgcgucggcaccaagcacgccauccuccugguggcggugagcuucgucacgcugaucaccgggaacauguccuuccgggaccucggccgcgugauggugauggucggggccaccaugaccgacgacaucggcaugggcgugacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugaugguccucaagaucgugcgcaacauggagaaguaccagcuggccgugaccaucauggccaucuccugcgucccgaacgccgugauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccugucccggaccagcaagaagcgcuccuggccgcucaacgaggccgucauggccgugggcauggugagcauccuggccuccagccugcucaagaacgacauccccaugaccgggccccuggucgccggcgggcugcucacggugugcuacgugcugaccggccggagcgcggaccuggagcucgagcgcgccgccgacgucaagugggaggaccaggccgagaucuccgggagcucccccauccugagcaucaccaucuccgaggacggcagcauguccaucaagaacgaggaggaggagcacacccugacgauccucauccggaccggccugcuggugaucagcgggguguucccggucuccauccccaucaccgccgcggccugguaccucugggaggugcgcaagcagcgggccggcgugcugugggacguccccagcccgccgcccguggggaaggccgagcuggaggacggcgccuaccgcaucaagcagcgggggaucuucggcuacucccagaucggcgcggggguguacaaggagggcaccuuccacaccauguggcacgucacgcgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggccuguucaagaccaacaccgggacgaucggcgcggucagccucgacuucucccccggcaccagcgggucccccaucguggaccgcaagggcaagguggucgggcuguacggcaacggcguggugacccggagcggggccuacgucuccgccaucgcccagaccgagaaguccaucgaggacaaccccgagaucgaggacgacaucuuccgcaagaagcggcugacgaucauggaccuccaccccggcgcggggaagaccaagcgcuaccugcccgccaucgugcgggaggccaucaagcgcggccugcgcacccugauccucgccccgacccggguggucgccgcggagauggaggaggcccugcgcgggcugcccauccgguaccagacgcccgccauccgcgccgagcacaccggccgggagaucguggaccucaugugccacgccaccuucaccaugcgccugcugagccccgugcgggucccgaacuacaaccucaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgcggccugccugcggaagaacggcaagaaggugauccagcugagccgcaagaccuucgacuccgaguacgucaagacccgggccaacgacugggacuucguggugacgaccgacaucagcgagaugggggccaacuuccgcgccgagcgggucaucgacccccgccggugcaugaagcccgugauccucaccgacggcgaggagcgcgugauccuggcggggcccaugccggucacccacuccagcgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccguccauguucgagcccgagcgcgagaagguggacgcgaucgacggggaguaccggcugcgcggcgaggcccggaagaccuucguggaccucaugcgccgcggggaccugcccgucuggcuggccuaccgcguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaaggcccgcgacgcccucgacaaccuggccgugcugcacaccgccgaggucggcgggcgggcguacaaccacgcccucagcgagcugcccgagacgcuggagacccuccugcugcucacccugcuggccaccgugacgggcggcaucuuccucuuccugauguccgggaagggcaucgggaagaugacccugggcaugugcugcaucaucaccgccagcauccuccugugguacgcccagauccagccgcacuggaucgcggccuccaucauccuggaguucuuccucaucgugcugcugauccccgagcccgagaagcagcgcacgccccaggacaaccagcucaccuacgucgugaucgccauccugacgguggucgccgccaccauggcgaacgagaugggguuccuggagaagaccaagaaggaccucggccugggcagcaucaccacgcaggagagcgaguccaacauccuggacaucgaccuccggccggccagcgccuggacccuguacgccguggccaccaccuucgugacgcccaugcugcgccacuccaucgagaacagcuccgucaacgugagccucaccgcgaucgccaaccaggccaccgugcugauggggcugggccgcggguggccccucuccaagauggacaucggcgucccccugcuggccaucgggugcuacagccaggugaacccgaucacccucacggcggcccugcugcuccugguggcccacuacgccaucaucggccccggccugcaggccaaggcgacccgggaggcccagaagcgcaccgccgccgggaucaugaagaaccccaccgucgacggcaucacggugaucgaccucgagcccaucccguacgaccccaaguucgagaagcagcugggccaggugaugcugcucguccugugcgugacccaggugcugaugaugcggaccaccugggcccucugcgaggcgcugacgcuggccaccggccccaucuccacccucugggaggggaaccccggccgcuucuggaacaccacgaucgccgucagcauggccaacaucuuccggggcuccuaccuggccggggcgggccuccucuucagcaucaugaagaacaccaccaacacccgccgggggacgggcaacaucggcgagacccugggggagaaguggaagucccagcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacauggugacgccggagggcaagguggucgaccucgggugcggccgcggcggguggagcuacuacugcggcgggcugaagaacgugcgcgaggugaaggggcugaccaagggcgggcccgggcacgaggagcccauccccauguccaccuacggcuggaaccucguccggcugcagagcgggguggacguguucuucaccccgcccgagaagugcgacacgcugcucugcgacaucggcgagagcucccccaaccccaccaucgaggccggccgcacccugcggguccugaaccucguggagaacuggcugaacaacaacacccaguucugcgugaagguccugaacccguacaugcccagcgugaucgagaagauggagacccuccagcgcaaguacgggggcgcccuggugcggaacccccugucccgcaacagcacgcacgagauguacugggucuccaacgccaccgggaacaucgugagcuccgugaacaugaucagccgcaugcugaucaaccgguucaccaugaagcacaagaaggccaccuacgagccggacgucgaccucggcuccgggacgcgcaacaucggcaucgagaacgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacgggguggucaagcugcucaccaagcccugggacguggugccgauggucacccagauggccaugaccgacacgacccccuucggccagcagcgcguguucaaggagaagguggacacccggacccaggagcccaaggagggcacgaagaagcugaugcgcaucaccgccgaguggcuguggaaggagcucgggaagaagaagacgccccggaugugcacccgcgaggaguucacgcggaagguccgcuccaacgccgcgcugggcgccaucuucaccgacgagaacaaguggaaguccgcccgggaggccguggaggacucccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcacaagcucggcuacauccugcgggacgucuccaagaaggagggcggggccauguacgcggacgacaccgccgggugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgcgggaccgugauggacaucaucagccggaaggaccagcgcggcuccggccaggucgggaccuacggccucaacaccuucacgaacauggaggcccagcugauccggcagauggagggggagggcaucuucaagagcauccagcgccugaccgugaccgaggagaucgcggugcagaacuggcucgcccgggucggccgcgagcggcugucccgcauggccaucagcggggacgacugcguggugaagccccuggacgaccgguucgccuccgcccucaccgcgcugaacgacaugggcaagguccgcaaggacauccagcagugggagcccagccggggguggaacgacuggacccaggugccguucugcucccaccacuuccacgagcuggugaugaaggacggccgcguccucguggugcccugccggaaccaggacgagcugaucgggcgcgcccggaucagccagggcgccggcuggucccugaaggagaccgccugccucggcaagagcuacgcccagauguggacccugauguacuuccaccgccgggaccugcgccucgcggccaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccugggcaagcgcgaggaccaguggugcgggagccucaucggccugacgagccgggccaccugggccaagaacauccagaccgccaucaaccagguccgcucccugaucgggaacgaggaguacaccgacuacaugcccagcaugaagcgguuccgcaaggaggaggaggaggcgggcgugcucugguga

SEQ ID NO: 9449 - RNA, 9876 nt, Artificial Sequence
  derived and/or modified CDS sequence (opt1) from DENV-2__EU482726__SS-prME
accgccggcgugaucgugaugcugauccccaccgugauggccuuccaccucaccacccggaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccggaccgagaccuggaugagcagcgagggggccuggaagcacgugcagcggaucgagacguggauccugcgccacccgggcuucaccaucauggccgccauccuggcguacaccaucgggaccacgcacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgccauguucacgugcaagaagaacauggagggcaagaucgugcagcccgagaaccuggaguacaccaucgucaucacgccccacagcggggaggagcacgcggugggcaacgacaccgggaagcacggcaaggagaucaagaucaccccgcaguccagcaccaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgccaagaagcaggacgucgugguccucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaucggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacgcccccgugaacaucgaggcggagccgcccuucggcgacagcuacaucaucgugggggucgagccgggccagcugaagcucaacugguucaagaagggguccagcaucggccagauguucgagacgaccaugcgcggcgccaagcggauggccauccugggggacaccgccugggacuucggcucccucgggggcguguucaccagcaucgggaaggcccuccaccagguguucggcgcgaucuacggcgccgccuucuccggggucagcuggacgaugaagauccugaucggcgugaucaucaccuggaucgggaugaacucccgcagcaccucccugagcgugucccugguccucgugggcguggucacccuguaccugggggccguggugcaggcggacagcggcugcgucguguccuggaagaacaaggagcucaagugcggcagcgggaucuucaucacggacaacgugcacaccuggaccgagcaguacaaguuccagcccgagucccccagcaagcuggccagcgccauccagaaggcccacgaggagggcaucugcgggauccgguccgucacccgccuggagaaccucauguggaagcagaucacgcccgagcugaaccacauccugagcgagaacgaggugaagcucaccaucaugaccggcgacaucaaggggaucaugcaggccggcaagcggucccugcgcccgcagcccaccgagcugaaguacagcuggaagacguggggcaaggcgaagaugcucuccaccgagagccacaaccagaccuuccugaucgacgggcccgagaccgccgagugcccgaacacgaaccgggccuggaacucccuggagguggaggacuacggcuucggggucuucaccaccaacaucuggcucaagcugcgcgagaagcaggacguguucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacgcagaccgcggggcccuggcaccucggcaagcuggagauggacuucgacuucugcgaggggaccaccgucguggugacggaggacugcggcaaccggggccccucccugcgcaccaccaccgccagcgggaagcucaucacggaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacccgcgucggcacgaagcacgcgacccugcucguggcccuguccuucgugacccugaucaccgggaacaugagcuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacguccaaggagcugaugauggccaccaucggcaucgcccuccugagccaguccacccugcccgagaccauccucgagcugacggacgcgcuggcccucgggaugauggugcugaagaucguccgcaacauggagaaguaccagcuggccgugaccaucauggccaucagcugcgugccgaacgccgucauccuccagaacgcguggaagguguccugcaccauccuggccgccgucagcgugagcccccugcuccugaccagcucccagcagaaggccgacuggaucccccuggcgcucacgaucaagggccugaaccccaccgccaucuuccugaccacccucagccggacguccaagaagcgcagcuggccgcugaacgaggccaucauggccgugggcauggucuccauccuggccagcucccuccugaagaacgacauccccaugaccgggccccugguggcgggcgggcuccugaccgugugcuacguccugaccggccggagcgccgaccucgagcuggagcgcgccgccgacgugaagugggaggaccaggccgagaucagcggguccagccccauccuguccaucacgaucagcgaggacggcuccaugagcaucaagaacgaggaggaggagcagacccucaccauccugauccggaccggccugcucgugaucuccggggucuucccggugagcauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacagccagaucggcgccggggucuacaaggagggcacguuccacaccauguggcacgugacccgcggggccgugcugaugcaccgcggcaagcggaucgagcccuccugggccgacgucaagaaggaccucaucagcuacgggggcggcuggaagcuggagggggaguggaaggagggcgaggagguccaggugcuggcccucgagcccgggaagaacccccgcgcgguccagaccaagcccggcaucuucaagacgaacaccgggaccaucggcgccgugucccuggacuucagccccggcaccuccgggagccccaucguggaccggaagggcaaggucguggggcuguacggcaacggcguggucacgcgcuccggggccuacgugagcgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucagccccguccgcgugccgaacuacaaccugaucaucauggacgaggcccacuucaccgaccccgccagcaucgccgcccggggcuacaucuccacccgcguggagaugggggaggcggccggcaucuucaugacggccacgccgcccgggagccgggacccguucccccaguccaacgcccccaucauggacgaggagcgcgagauccccgagcggagcuggaacuccggccacgagugggucaccgacuucaaggggaagaccgugugguucgugccgagcaucaaggcgggcaacgacaucgccgccugccugcgcaagaacggcaagaaggucauccagcucucccggaagacguucgacagcgaguacgugaagacccgcgccaacgacugggacuucguggucaccaccgacaucuccgagaugggggccaacuuccgggcggagcgcgugaucgacccccggcgcugcaugaagcccgugauccugacggacggcgaggagcgggucauccuggccgggcccaugccggugacccacagcuccgccgcccagcgccgcggccggaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacgggaucaagaacaaccagauccuggaggagaacgucgagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccguccuccacaccgcggaggugggcgggcgcgccuacaaccacgcccuguccgagcugcccgagacccucgagacccugcugcuccugacgcugcucgccaccgugaccggcggcaucuuccuguuccugaugagcgggaagggcaucgggaagaugacccucggcaugugcugcaucaucaccgccuccauccugcugugguacgcgcagauccagccgcacuggaucgccgccagcaucauccucgaguucuuccugaucguccugcucauccccgagcccgagaagcagcggacgccccaggacaaccagcugaccuacguggugaucgccauccugaccgucguggccgcgaccauggccaacgagaugggguuccucgagaagacgaagaaggaccugggccugggcuccaucaccacccaggagagcgagagcaacauccucgacaucgaccugcgcccggccuccgccuggacccuguacgccguggcgacgaccuucgucacccccaugcuccggcacagcaucgagaacuccagcgugaacgugucccugaccgccaucgccaaccaggccacgguccugauggggcucggccgcggguggccccugagcaagauggacaucggcgugccccugcucgcgaucgggugcuacucccaggugaacccgaucacccugaccgccgcccugcuccugcuggucgcccacuacgccaucaucggccccggccuccaggcgaaggccacccgcgaggcccagaagcggacggccgccgggaucaugaagaaccccaccguggacggcaucaccgugaucgaccuggagcccaucccguacgaccccaaguucgagaagcagcuggggcaggucaugcuccuggugcugugcgugacccagguccucaugaugcgcacgaccugggcgcugugcgaggcccugacccucgccaccggccccaucagcacgcugugggaggggaaccccggccgguucuggaacaccaccaucgccguguccauggccaacaucuuccgcggcagcuaccuggcgggggccggccuccuguucuccaucaugaagaacaccacgaacacccggcgcgggaccggcaacaucggcgagacccugggggagaaguggaagucccggcucaacgcccugggcaaguccgaguuccagaucuacaagaaguccgggauccaggagguggaccgcacgcuggccaaggagggcaucaagcgcggggagaccgaccaccacgcggucucccgcggcagcgccaagcuccggugguucguggagcgcaacauggugaccccggagggcaaggucguggaccuggggugcggccgcgggggcugguccuacuacugcgggggccugaagaacgugcgcgaggucaagggccucaccaagggcggccccgggcacgaggagcccauccccaugagcacguacggcuggaaccuggugcggcugcaguccgggguggacgucuucuucaccccgcccgagaagugcgacacccuccugugcgacaucggcgagagcagccccaaccccaccaucgaggccggccgcacccugcgggugcucaaccugguggagaacuggcugaacaacaacacgcaguucugcaucaagguccucaacccguacaugcccuccgugaucgagaagauggagacccugcagcgcaaguacgggggcgcccuggugcggaacccccugagccgcaacuccacccacgagauguacugggucagcaacgccaccgggaacaucguguccagcgugaacaugaucucccgcaugcucaucaaccgguucacgaugaagcacaagaaggcgaccuacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacgggguggucaagcuccugaccaagcccugggacguggugccgauggucacgcagauggccaugaccgacaccacccccuucggccagcagcgcguguucaaggagaagguggacacgcggacccaggagcccaaggagggcaccaagaagcugaugcgcaucaccgccgaguggcucuggaaggagcuggggaagaagaagacgccccggaugugcacccgcgaggaguucacccggaagguccgcuccaacgcggcccugggcgccaucuucaccgacgagaacaaguggaaguccgcccgggaggccguggaggacucccgcuucugggagcucgucgaccgggagcgcaaccugcaccuggaggggaagugcgagacgugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgggaacagccugagcggcguggagggggagggccuccaccggcugggcuacauccugcgcgaggucgggaagaaggagggcggggcgauguacgccgacgacaccgccggcugggacacccggaucacccucgaggaccugaagaacgaggagauggugacgaaccacaugaagggggagcacaagaagcuggccgaggccaucuucaagcucaccuaccagaacaaggugguccgcgugcagcgcccgacgccccggggcaccgugauggacaucaucucccgcaaggaccagcggggcagcgggcaggucggcacguacgggcugaacaccuucaccaacauggaggcgcagcugauccgccagauggagggcgagggcaucuucaaguccauccagcaccucaccgccacggaggagaucgccgugcagaacuggcuggcccggguggggcgcgagcggcugagccgcauggccaucuccggcgacgacugcgucgugaagcccaucgacgaccgguucgcgagcgcccucaccgcccugaacgacauggggaaggugcgcaaggacauccagcagugggagcccucccggggcuggaacgacuggacccaggucccguucugcagccaccacuuccacgagcuggugaugaaggacgggcgcgugcucgucgugcccugccggaaccaggacgagcugaucggccgcgcccggaucucccagggcgccggguggagccugaaggagaccgcgugccucggcaaguccuacgcccagauguggacccugauguacuuccaccgccgggaccugcgccucgccgccaacgccaucugcagcgcggugcccucccacuggguccccacgagccggaccaccugguccauccacgccaagcacgaguggaugaccacggaggacaugcuggccguguggaaccgcguguggauccaggagaacccguggauggaggacaagacccccgucgagagcugggaggaggugcccuaccuggggaagcgcgaggaccaguggugcggcucccucaucgggcugaccagccgggccaccugggcgaagaacauccagacggccaucaaccaggugcgcagccugaucggcaacgaggaguacaccgacuacaugcccuccaugaagcgguuccgccgggaggaggaggaggccggcguccucugguga

SEQ ID NO: 9450 - RNA, 9876 nt, Artificial Sequence
  derived and/or modified CDS sequence (opt1) from DENV-2__EU482727__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgccuacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcggccccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggugguccgccugcucaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcuguggaaggagcucgggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagacgugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccggcgcaacagccuguccgggguggagggcgaggggcugcacaagcucggcuacauccugcgggacgucagcaagaaggagggcggggcgauguacgccgacgacaccgccggcugggacacccgcaucacccuggaggaccucaagaacgaggagauggugacgaaccacaugaagggggagcacaagaagcuggccgaggccaucuucaagcugaccuaccagaacaaggugguccgcgugcagcggccgacgccccggggcaccgugauggacaucaucucccggaaggaccagcgcgggagcggccaggucggcacguacgggcucaacaccuucaccaacauggaggcgcagcugauccggcagauggagggcgaggggaucuucaaguccauccagcgccugaccgugacggaggagaucgccgugcagaacuggcucgcccgggucggccgcgagcggcugagccgcauggccaucuccggcgacgacugcguggugaagccccuggacgaccgguucgccagcgcgcucaccgcccugaacgacauggggaagguccgcaaggacauccagcagugggagcccucccggggcuggaacgacuggacccaggugccguucugcagccaccacuuccacgagcuggugaugaaggacgggcgcguccucguggugcccugccggaaccaggacgagcugaucggccgcgcccggaucucccagggggccggcuggagccugaaggagaccgccugccucggcaaguccuacgcgcagauguggacgcugauguacuuccaccgccgggaccugcgccucgccgccaacgccaucugcagcgccguccccucccacugggugcccaccagccgcaccaccugguccauccacgcgaagcacgaguggaugaccacggaggacaugcuggccguguggaaccgggucuggauccaggagaacccguggauggaggacaagacccccguggagagcugggaggaggugcccuaccuggggaagcgcgaggaccaguggugcggcagccucaucgggcugaccucccgggccaccugggccaagaacauccagacggcgaucaaccagguccgcagccugaucggcaacgaggaguacaccgacuacaugcccuccaugaagcgguuccgcaaggaggaggaggaggccggggugcucugguga

SEQ ID NO: 9451 - RNA, 9876 nt, Artificial Sequence
  derived and/or modified CDS sequence (opt1) from DENV-2__EU482728__SS-prME
accgccggcgugaucaucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacucccucguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggugaugguccaggccgacuccggcugcguggugagcuggaagaacaaggagcugaagugcggcuccgggaucuucaucaccgacaacguccacacguggaccgagcaguacaaguuccagcccgagagccccagcaagcucgcguccgccauccagaaggcccacgaggagggcaucugcgggauccggagcgugacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggccaagaugcugagcacggagucccacaaccagaccuuccucaucgacgggcccgagaccgcggagugcccgaacaccaaccgggccuggaacagccuggaggucgaggacuacggcuucgggguguucuccacgaacaucuggcugaagcuccgcgagaagcaggacguguucugcgacagcaagcugauguccgccgccaucaaggacaaccgggccguccacgcggacaugggcuacuggaucgagagcgcccugaacgacaccuggaagauggagaaggccuccuucaucgaggucaagagcugccacuggcccaagucccacacccucuggagcaacggcgugcuggaguccgagaugaucauccccaagaacuucgccgggcccgugagccagcacaacuaccgcccgggcuaccacacccagaccgccgggcccuggcaccugggcaagcucgagauggacuucgacuucugcgaggggacgaccgugguggucaccgaggacugcggcaaccggggccccagccugcgcaccacgaccgcguccgggaagcugaucaccgaguggugcugccggagcugcacccugccgccccugcgcuaccggggcgaggacgggugcugguacggcauggagauccgcccccugaaggagaaggaggagaaccucgugaacucccuggugacggccgggcacggccagaucgacaacuucagccugggcguccucgggauggcccuguuccuggaggagaugcuccggacccgcgugggcaccaagcacgccauccugcugguggcggucuccuucgugacccucaucacggggaacaugagcuuccgggaccugggccgcgugauggucauggugggggccaccaugaccgacgacaucggcaugggcgugaccuaccuggcccuccuggccgccuucaagguccgccccacguucgcggccgggcugcuccugcggaagcugaccuccaaggagcucaugauggccaccaucggcaucgcccugcugagccaguccaccauccccgagacgauccucgagcugaccgacgcccuggcgcucgggaugauggugcugaagaucgugcgcaacauggagaaguaccagcuggccgucaccaucauggccaucagcugcgugcccaacgccgugauccuccagaacgccuggaaggucuccugcaccauccuggcggccgugagcgucagcccccugcuccugacgagcucccagcagaaggccgacuggaucccccuggcccucaccaucaagggccugaaccccaccgcgaucuuccugaccacgcucagccggaccuccaagaagcgcagcuggccgcugaacgaggccgugauggccgugggcauggucuccauccuggccagcagccuccugaagaacgacauccccaugaccgggccccugguggccggcgggcuccugaccgugugcuacguccugacgggccgguccgcggaccucgagcuggagcgcgccgccgacgugaagugggaggaccaggccgagaucagcggguccagccccauccuguccaucaccaucagcgaggacggcuccaugagcaucaagaacgaggaggaggagcagacccucaccauccugauccggacgggccugcucgugaucuccggggucuucccggugagcauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacagccagaucggcgcgggggucuacaaggagggcaccuuccacaccauguggcacgugacccgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugucccuggacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucucccccguccgcgugccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcucucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccugaccgacggcgaggagcgggucauccuggcggggcccaugccggugacccacagcuccgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacuccgacccccuggcccugaaggaguucaaggaguucgccgcgggccgcaagagccucacccugaaccugaucaccgagauggggcggcuccccacguucaugacccagaaggcccgggacgcccuggacaaccuggccguccuccacaccgccgaggugggcgggcgcgcguacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaccacccaggaguccgagagcaacauccucgacaucgaccugcgcccggccuccgccuggacgcuguacgccguggccaccaccuucgucacccccaugcuccggcacagcaucgagaacuccagcgugaacgugucccugacggcgaucgccaaccaggccaccguccugauggggcucggccgcggguggccccugagcaagauggacaucggcgugccccugcucgccaucgggugcuacucccaggugaacccgaucacccugaccgcggcccugcuccugcuggucgcccacuacgccaucaucggccccggccuccaggccaaggcgacgcgcgaggcccagaagcgggccgccgccgggaucaugaagaaccccaccguggacggcaucaccgugaucgaccuggagcccaucccguacgaccccaaguucgagaagcagcuggggcaggucaugcuccuggugcugugcgugacccagguccucaugaugcgcacgaccugggcgcugugcgaggcccugacccucgccaccggccccaucagcacgcugugggaggggaaccccggccgguucuggaacaccaccaucgccguguccauggccaacaucuuccgcggcagcuaccuggcgggggccggccuccuguucuccaucaugaagaacaccacgaacacccggcgcgggaccggcaacaucggcgagacccugggggagaaguggaagucccggcucaacgcccugggcaaguccgaguuccagaucuacaagaaguccgggauccaggagguggaccgcacgcuggccaaggagggcaucaagcgcggggagaccgaccaccacgcggucucccgcggcagcgccaagcuccggugguucguggagcgcaacauggugaccccggagggcaaggucguggaccuggggugcggccgcgggggcugguccuacuacugcgggggccugaagaacgugcgcgaggucaagggccucaccaagggcggccccgggcacgaggagcccauccccaugagcacguacggcuggaaccuggugcggcugcagagcgggguggacgucuucuucaccccgcccgagaagugcgacacccuccugugcgacaucggcgaguccagccccaaccccaccaucgaggccggccgcacgcugcgggugcucaaccugguggagaacuggcugaacaacaacacccaguucugcaucaagguccucaacccguacaugcccuccgugaucgagaagauggagacccugcagcgcaaguacgggggcgcccuggugcggaacccccugagccgcaacuccacccacgagauguacugggucagcaacgccaccgggaacaucguguccagcgugaacaugaucucccgcaugcucaucaaccgguucacgaugaagcacaagaaggcgaccuacgagccggacgucgaccugggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggugguccgccuccugaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcucuggaaggagcuggggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcucgucgaccgcgagcggaaccugcaccuggaggggaagugcgagacgugcguguacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggggaacagccuguccggcguggagggggagggccuccacaagcugggcuacauccugcgcgacgucagcaagaaggagggcggcgcgauguacgccgacgacaccgccgggugggacacccggaucacccucgaggaccugaagaacgaggagauggugacgaaccacaugaagggcgagcacaagaagcuggccgaggccaucuucaagcucaccuaccagaacaaggugguccgcgugcagcgcccgacgccccgggggaccgugauggacaucaucucccgcaaggaccagcggggcagcggccaggucgggaccuacggccugaacaccuucaccaacauggaggcgcagcugauccgccagauggagggggagggcaucuucaaguccauccagcggcucaccgugacggaggagaucgccgugcagaacuggcuggcccgcgucggccgggagcgccugagccggauggccaucuccggggacgacugcguggugaagccccucgacgaccgcuucgccagcgcgcugaccgcccugaacgacaugggcaagguccggaaggacauccagcagugggagcccucccgcggguggaacgacuggacccaggugccguucugcagccaccacuuccacgagcucgugaugaaggacggccggguccugguggugcccugccgcaaccaggacgagcugaucgggcgggcccgcaucucccagggcgccggcuggagccucaaggagaccgccugccuggggaaguccuacgcgcagauguggacgcugauguacuuccaccggcgcgaccuccggcuggccgccaacgccaucugcagcgccguccccucccacugggugcccaccagccgcaccaccugguccauccacgcgaagcacgaguggaugaccacggaggacaugcuggccguguggaaccgcgucuggauccaggagaacccguggauggaggacaagacccccguggagagcugggaggaggugcccuaccucggcaagcgggaggaccaguggugcgggagccugaucggccugaccucccgcgccaccugggccaagaacauccagacggcgaucaaccagguccggagccucaucgggaacgaggaguacaccgacuacaugcccuccaugaagcgcuuccggaaggaggaggaggaggccggcgugcugugguga

SEQ ID NO: 9452 - RNA, 9876 nt, Artificial Sequence
  derived and/or modified CDS sequence (opt1) from DENV-2__EU482729__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgagaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaucgccgggcccuggcaccugggcaagcuggagauggacuucgacuucugcgaggggaccacggugguggucaccgaggacugcggcaaccggggccccagccuccgcaccaccacggcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacgcgcgugggcaccaagcacgccauccuccugaucgcgguguccuucgucacccugaucaccgggaacaugagcuuccgggaccucggccgcgugauggugauggucggggccacgaugaccgacgacaucggcaugggcgugaccuaccuggcccugcucgccgccuucaaggugcgccccaccuucgcggccgggcugcugcuccggaagcugacguccaaggagcugaugauggccaccaucggcaucgcccuccugagccaguccaccauccccgagaccauccuggagcucacggacgcccuggcgcuggggaugaugguccucaagaucgugcgcaacauggagaaguaccagcuggccgugaccaucauggccaucagcugcgucccgaacgccgugauccugcagaacgccuggaagguguccugcaccauccucgcggccgucagcgugagcccccugcugcucaccagcucccagcagaaggccgacuggaucccccuggcccugacgaucaagggccucaaccccaccgcgaucuuccugaccacccugagccggacguccaagaagcgcagcuggccgcucaacgaggccgucauggccgugggcaugguguccauccuggccagcagccugcucaagaacgacauccccaugaccgggccccuggucgccggcgggcugcucaccgugugcuacgugcugaccggccgguccgcggaccuggagcucgagcgcgccgccgacgucaagugggaggaccaggccgagaucagcggguccagccccauccuguccaucacgaucagcgaggacggcuccaugagcaucaagaacgaggaggaggagcagacccugaccauccucauccggaccggccugcuggugaucuccgggguguucccggucagcauccccaucacggccgcggccugguaccucugggaggugaagaagcagcgcgccggcgugcugugggacguccccagcccgccgcccguggggaaggccgagcuggaggacggcgccuaccggaucaagcagcgcgggaucuucggcuacagccagaucggcgcggggguguacaaggagggcaccuuccacaccauguggcacgucacccgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgccgugcagaccaagcccggccuguucaagacgaacaccgggaccaucggcgcggucucccucgacuucagccccggcaccuccgggagccccaucguggaccggaagggcaagguggucgggcuguacggcaacggcguggugacgcgcuccggggccuacgucagcgccaucgcccagaccgagaaguccaucgaggacaaccccgagaucgaggacgacaucuuccggaagaagcgccugaccaucauggaccuccaccccggcgcggggaagaccaagcgguaccugcccgccaucgugcgcgaggccaucaagcggggccugcgcacgcugauccucgccccgacccgcguggucgccgcggagauggaggaggcccugcgggggcugcccauccgcuaccagacccccgccauccgggccgagcacaccggccgcgagaucguggaccucaugugccacgccacguucaccaugcggcugcugucccccgugcgcgucccgaacuacaaccucaucaucauggacgaggcgcacuucaccgaccccgccagcaucgccgcccggggcuacaucuccacccgcguggagaugggggaggccgcgggcaucuucaugacggccacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggccggcaacgacaucgcggccugccugcgcaagaacggcaagaaggugauccagcugucccggaagacguucgacagcgaguacgucaagacccgcgccaacgacugggacuucguggugaccaccgacaucuccgagaugggggccaacuuccgggccgagcgcgucaucgacccccggcgcugcaugaagcccgugauccucacggacggcgaggagcgggugauccuggcggggcccaugccggucacccacagcuccgccgcccagcgccgcggccggaucgggcgcaaccccaagaacgagaacgaccaguacaucuacaugggcgagccccuggagaacgacgaggacugcgccuacuggaaggaggccaagaugcuccuggacaacaucaacacccccgagggcaucaucccgagcauguucgagcccgagcgggagaagguggacgcgaucgacggggaguaccgccugcggggcgaggcccgcaagaccuucguggaccucaugcggcgcggggaccugcccgucuggcuggccuaccggguggccgccgagggcaucaacuacgcggaccgccgguggugcuucgacgggaucaagaacaaccagauccucgaggagaacguggaggucgagaucuggacgaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccaccuucaugacgcagaaggcccgggacgcccucgacaaccuggccgugcugcacaccgccgaggucggcgggcgcgcguacaaccacgcccucuccgagcugcccgagacccuggagacccuccugcugcucacgcugcuggccaccgugaccggcggcaucuuccucuuccugaugagcgggaagggcaucgggaagaugacccugggcaugugcugcaucaucacggccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggguuccuggagaagacgaagaaggaccucggccugggcagcaucaccacccaggaguccgagagcaacauccuggacaucgaccuccgcccggccuccgccuggacccuguacgccguggccacgaccuucgugacccccaugcugcggcacagcaucgagaacuccagcgucaacgugucccucaccgcgaucgccaaccaggccacggugcugauggggcugggccgcggguggccccucagcaagauggacaucggcgucccccugcuggccaucgggugcuacucccaggugaacccgaucacccucaccgcggcccugcugcuccugguggcccacuacgccaucaucggccccggccugcaggccaaggcgacccgcgaggcccagaagcgggccgccgccgggaucaugaagaaccccacggucgacggcaucaccgugaucgaccucgagcccaucccguacgaccccaaguucgagaagcagcugggccaggugaugcugcucguccugugcgugacccaggugcugaugaugcgcaccacgugggcgcucugcgaggcccugacccuggccaccggccccaucagcacccucugggaggggaaccccggccgguucuggaacacgaccaucgccgucuccauggccaacaucuuccgcggcagcuaccuggcgggggccggccuccucuucuccaucaugaagaacaccaccaacacgcggcgcgggaccggcaacaccggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggugucccgcggcagcgccaagcugcggugguucgucgagcgcaacauggugaccccggagggcaagguggucgaccucgggugcggccgcggcgggugguccuacuacugcggcgggcugaagaacgugcgcgaggugaaggggcugaccaagggcgggcccgggcacgaggagcccauccccaugagcacguacggcuggaaccucguccggcugcagagcgggguggacguguucuucaccccgcccgagaagugcgacacccugcucugcgacaucggcgaguccagccccaaccccaccaucgaggccggccgcacgcugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacccacgagauguacugggugagcaacgccaccgggaacaucgucuccagcgugaacaugaucucccgcaugcugaucaaccgguucacgaugaagcacaagaaggcgaccuacgagccggacguggaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggucaacgggguggugcgccugcucaccaagcccugggacgucgugccgauggugacgcagauggccaugaccgacaccacccccuucggccagcagcgggucuucaaggagaagguggacacgcgcacccaggagcccaaggagggcaccaagaagcugaugcggaucaccgccgaguggcuguggaaggagcucgggaagaagaagacgccccgcaugugcacccgggaggaguucacccgcaaggugcggagcaacgcggcccugggcgccaucuucaccgacgagaacaaguggaaguccgcccgcgaggccgucgaggacagccgguucugggagcugguggaccgcgagcggaaccuccaccuggaggggaagugcgagacgugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccggcgcaacagccuguccgggguggagggcgaggggcugcacaagcucggcuacauccugcgggacgugagcaagaaggagggcggggcgauguacgccgacgacaccgccggcugggacacccgcaucacccuggaggaccucaagaacgaggagauggucacgaaccacaugaagggggagcacaagaagcuggccgaggccaucuucaagcugaccuaccagaacaagguggugcgcguccagcggccgacgccccggggcaccgugauggacaucaucucccggaaggaccagcgcgggagcggccaggugggcacguacgggcucaacaccuucaccaacauggaggcgcagcugauccggcagauggagggcgaggggaucuucaaguccauccagcgccugaccgucacggaggagaucgccgugcagaacuggcucgcccgggugggccgcgagcggcugagccgcauggccaucuccggcgacgacugcgucgugaagccccuggacgaccgguucgccagcgcgcucaccgcccugaacgacauggggaaggugcgcaaggacauccagcagugggagcccucccggggcuggaacgacuggacccaggucccguucugcagccaccacuuccacgagcuggugaugaaggacgggcgcgugcucgucgugcccugccggaaccaggacgagcugaucggccgcgcccggaucucccagggggccggcuggagccugaaggagaccgccugccucggcaaguccuacgcgcagauguggacgcugauguacuuccaccgccgggaccugcgccucgccgccaacgccaucugcagcgccgugcccucccacuggguccccaccagccgcaccaccugguccauccacgcgaagcacgaguggaugaccacggaggacaugcuggccguguggaaccggguguggauccaggagaacccguggauggaggacaagacccccgucgagagcugggaggaggugcccuaccuggggaagcgcgaggaccaguggugcggcagccucaucgggcugaccucccgggccaccugggccaagaacauccagacggcgaucaaccaggugcgcagccugaucggcaacgaggaguacaccgacuacaugcccuccaugaagcgguuccgcaaggaggaggaggaggccgggguccucugguga

SEQ ID NO: 9453 - RNA, 9876 nt, Artificial Sequence
  derived and/or modified CDS sequence (opt1) from DENV-2__EU482731__SS-prME
accgccggcgugaucgucaugcugauccccaccgugauggccuuccaccucaccacccggaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccggaccgagaccuggaugagcuccgagggggccuggaagcacgugcagcggaucgagaccuggauccugcgccacccgggcuucaccaucauggccgccauccuggcguacaccaucgggaccacgcacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgccauguucacgugcaagaagaacauggagggcaagaucgugcagcccgagaaccuggaguacaccaucgucaucacgccccacagcggggaggagcacgcggugggcaacgacaccgggaagcacggcaaggagaucaagaucaccccgcaguccagcaccaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgccaagaagcaggacgucgugguccucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacgcccccgugaacaucgaggcggagccgcccuucggcgacagcuacaucaucgugggggucgagccgggccagcugaagcucaacugguucaagaagggguccagcaucggccagauguucgagaccaccaugcgcggcgccaagcggauggccauccugggggacaccgccugggacuucggcucccucggcgggguguucacgagcaucgggaaggcccuccaccagguguucggggcgaucuacggcgccgccuucuccggggucagcuggaccaugaagauccugaucggcgugaucaucaccuggaucgggaugaacucccgcagcaccucccugagcgugucccugguccucgugggcguggucacgcuguaccugggggccauggugcaggcggacagcggcugcguggucuccuggaagaacaaggagcucaagugcggcagcgggaucuucaucaccgacaacgugcacaccuggaccgagcaguacaaguuccagcccgagucccccagcaagcuggccagcgccauccagaaggcccacgaggagggcaucugcgggauccgguccgugacgcgccuggagaaccucauguggaagcagaucacccccgagcugaaccacauccugagcgagaacgaggucaagcucaccaucaugaccggcgacaucaaggggaucaugcaggccggcaagcggucccugcgcccgcagcccacggagcugaaguacagcuggaagaccuggggcaaggcgaagaugcucuccaccgagagccacaaccagaccuuccugaucgacgggcccgagacggccgagugcccgaacaccaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacgcuguggagcaacggcgugcuggaguccgagaugaucauccccaagaacuucgccgggcccgugagccagcacaacuaccgcccgggcuaccacacccagaccgcggggcccuggcaccucggcaagcuggagauggacuucgacuucugcgaggggaccacgguggucgugaccgaggacugcggcaaccggggccccucccugcgcaccaccacggccagcgggaagcucaucaccgaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacgcgcgugggcaccaagcacgcgacccugcucgucgcccuguccuucgugacccugaucacggggaacaugagcuuccgggaccucggccgcgugauggucauggugggggccaccaugaccgacgacaucggcaugggcgugaccuaccuggcccugcucgccgcguucaagguccgccccacguucgccgccgggcugcugcuccggaagcugaccuccaaggagcugaugauggccaccaucggcaucgcccuccugagccaguccacccugcccgagacgauccucgagcugaccgacgcgcuggcccucgggaugauggugcugaagaucgugcgcaacauggagaaguaccagcuggccgucaccaucauggccaucagcugcgugccgaacgccgugauccuccagaacgcguggaaggucuccugcaccauccuggccgccgugagcgucagcccccugcuccugacgagcucccagcagaaggccgacuggaucccccuggcgcucaccaucaagggccugaaccccaccgccaucuuccugaccacgcucagccggaccuccaagaagcgcagcuggccgcugaacgaggccaucauggccgugggcaugguguccauccuggccagcucccuccugaagaacgacauccccaugaccgggccccuggucgcgggcgggcuccugaccgugugcuacgugcugacgggccggagcgccgaccucgagcuggagcgcgccgccgacgucaagugggaggaccaggccgagaucagcggguccagccccauccuguccaucaccaucagcgaggacggcuccaugagcaucaagaacgaggaggaggagcagacccucaccauccugauccggaccggccugcucgugaucuccgggguguucccggucagcauccccaucacggcggccgccugguaccugugggaggugaagaagcagcgcgccggcgugcugugggacguccccagcccgccgcccguggggaaggccgagcucgaggacggcgcguaccggaucaagcagcgcgggauccugggcuacagccagaucggcgccgggguguacaaggagggcaccuuccacaccauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcccucgagcccgggaagaacccccgcgcggugcagacgaagcccggcaucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucagccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucaucgacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagacguucguggaccugaugcgccgcggggaccugcccgucuggcucgccuacaagguggccgcggagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcaacgcccuggacaaccuggccgugcuccacaccgcggaggucggcgggcgggcccacaaccacgcccuguccgagcugcccgagacccucgagacgcugcugcuccugacccugcucgccaccgugaccggcggcaucuuccuguuccugaugagcgggaagggcaucgggaagaugacccucggcaugugcugcaucaucacggccuccauccugcugugguacgcgcagauccagccgcacuggaucgccgccagcaucauccucgaguucuuccugaucgugcugcucauccccgagcccgagaagcagcgcacgccccaggacaaccagcugaccuacgucgugaucgccauccugaccguggucgccgcgacgauggccaacgagaugggguuccucgagaagaccaagaaggaccugggcuucggcuccaucaccacccaggagagcgagagcaacauccuggacaucgaccuccggccggccuccgccuggacgcuguacgccguggcgaccaccuucgugacccccaugcugcgccacagcaucgagaacuccagcgucaacgugucccucacggccaucgccaaccaggccaccgugcugauggggcugggcaagggguggccccucagcaagauggacaucggcgucccccugcuggcgaucgggugcuacucccaggugaacccgaucacccucaccgccgcccugcugcuccugguggcccacuacgccaucaucggccccggccugcaggcgaaggccacgcgggaggcccagaagcgcgccgccgcggggaucaugaagaaccccaccgucgacggcaucaccgugaucgaccucgagcccaucccguacgaccccaaguucgagaagcagcugggccaggugaugcugcucauccugugcgucacccaggugcugaugaugcggacgaccugggcccucugcgaggcccugacccuggccaccggccccaucagcacgcucugggaggggaaccccggccgcuucuggaacaccaccaucgccguguccauggcgaacaucuuccgcggcagcuaccuggccggggccggccuccuguucuccaucaugaagaacaccacgaacacccggcgcgggaccggcaacgucggcgagacccugggggagaaguggaagucccggcugaacgcccucggcaaguccgaguuccagaucuacaagaaguccgggauccaggagguggaccgcacgcuggcgaaggagggcaucaagcgcggggagaccgaccaccacgccgugucccgcggcagcgccaagcugcggugguucgucgagcgcaacauggugaccccggagggcaagguggucgaccucgggugcggccgcggcgggugguccuacuacugcggcgggcugaagaacgugcgcgaggugaaggggcugaccaagggcgggcccgggcacgaggagcccauccccaugagcacguacggcuggaaccucguccggcugcaguccgggguggacguguucuucaccccgcccgagaagugcgacacccugcucugcgacaucggcgagagcagccccaaccccaccaucgaggccggccgcacccugcggguccugaaccucguggagaacuggcugaacaacaacacgcaguucugcaucaaggugcugaacccguacaugcccuccgucaucgagaagauggagacccuccagcgcaaguacgggggcgcccuggugcggaacccccugagccgcaacuccacccacgagauguacugggugagcaacgcgaccgggaacaucgucuccagcgugaacaugaucucccggaugcugaucaaccgcuucacgaugaagcacaagaaggccaccuacgagccggacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggucaacgggguggugcgccugcucaccaagcccugggacgucgugccgauggugacgcagauggccaugaccgacaccacccccuucggccagcagcgggucuucaaggagaagguggacacgcgcacccaggagcccaaggagggcaccaagaagcugaugaagaucaccgcggaguggcuguggaaggagcucgggaagaagaagacgccccggaugugcacccgcgaggaguucacccggaaggugcgcuccaacgccgcccugggcgccaucuucaccgacgagaacaaguggaaguccgcccgggaggcggucgaggacgggcgcuucugggagcugguggaccgggagcgcaaccuccaccuggagggcaagugcgagacgugcgucuacaacaugauggggaagcgggagaagaagcugggcgaguucggcaaggccaaggggucccgcgccaucugguacauguggcucggcgcccgguuccuggaguucgaggcgcugggguuccucaacgaggaccacugguucagccgcggcaacucccugagcgggguggagggcgagggccugcaccggcucggguacauccugcgcgaggugggcaagaaggagggcggcgccauguacgccgacgacaccgccgggugggacacccggaucacccuggaggaccucaagaacgaggagauggucacgaaccacaugaagggcgagcacaagaagcuggccgaggcgaucuucaagcugaccuaccagaacaagguggugcgcguccagcggccgacgccccggggcaccgugauggacaucaucagccggaaggaccagcgcggguccggccagguggggacguacggccucaacaccuucaccaacauggaggcccagcugauccgccagauggagggcgaggggaucuucaagagcauccagcaccugaccgccacggaggagaucgccguccagaacuggcucgcccgggugggccgcgagcggcugucccgcauggcgaucagcggggacgacugcguggucaagcccaucgacgaccgguucgccuccgcccugaccgcccucaacgacaugggcaaggugcgcaaggacauccagcagugggagcccagccggggguggaacgacuggacccaggugccguucugcucccaccacuuccacgagcuggucaugaaggacggccgcgugcuggugguccccugccggaaccaggacgagcucaucggccgcgcccggaucagccagggggcgggcuggucccugaaggagaccgccugccugggcaagagcuacgcccagauguggacccucauguacuuccaccgccgggaccugcgccuggccgccaacgcgaucugcuccgccgugcccagccacugggugcccacgucccggaccaccuggagcauccacgccaagcacgaguggaugaccacggaggacaugcucgccgucuggaaccgcguguggauccaggagaacccguggauggaggacaagacccccguggaguccugggaggagguccccuaccugggcaagcgggaggaccaguggugcgggagccugaucggccucaccucccgcgcgaccugggccaagaacauccagacggccaucaaccaggugcggagccugaucggcaacgaggaguacaccgacuacaugcccagcaugaagcgcuuccgccgggaggaggaggaggccggggugcugugguga

SEQ ID NO: 9454 - RNA, 9876 nt, Artificial Sequence
  derived and/or modified CDS sequence (opt1) from DENV-2__EU482732__SS-prME
accgugggcgucaucaucaugcugauccccaccgccauggccuuccaccucaccacccgcaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgccauccuggcguacaccaucgggaccacgcacuuccagcgggcccucaucuucauccugcugaccgccguggcccccagcaugaccaugcgcugcaucggcaucuccaaccgggacuucgucgagggcgugagcgggggcuccuggguggacaucguccucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgccauguucacgugcaagaagaacauggagggcaagguggugcugcccgagaaccuggaguacaccaucgucaucacgccccacagcggggaggagcacgcggugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgccaagaagcaggacgucgugguccuggggucccaggagggcgcgaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccacgaugcgcggcgcgaagcggauggccauccugggggacaccgccugggacuucggcagccucgggggcgccuucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcacacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacgggguggucaagcugcucaccaagcccugggacguggugccgauggucacgcagauggccaugaccgacaccacccccuucggccagcagcgcguguucaaggagaagguggacacgcggacccaggagcccaaggagggcaccaagaagcugaugcgcaucaccgccgaguggcuguggaaggagcucgggaagaagaagacgccccggaugugcacccgcgaggaguucacccggaagguccgcagcaacgcggcccugggcgccaucuucaccgacgagaacaaguggaaguccgcccgggaggccguggaggacagccgcuucugggagcuggucgaccgggagcgcaaccuccaccuggaggggaagugcgagacgugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgggaacagccuguccggcguggagggggagggccugcacaagcucggcuacauccugcgggacgucagcaagaaggagggcggcgcgauguacgccgacgacaccgccgggugggacacccgcaucacccuggaggaccucaagaacgaggagauggugacgaaccacaugaagggcgagcacaagaagcuggccgaggccaucuucaagcugaccuaccagaacaaggugguccgggugcagcgcccgacgccccgggggaccgugauggacaucaucucccggaaggaccagcgcggcagcggccaggucgggacguacggccucaacaccuucaccaacauggaggcgcagcugauccggcagauggagggggagggcaucuucaaguccauccagcgccugaccgugacggaggagaucgccgugcagaacuggcucgcccgggucggccgcgagcggcugagccgcauggccaucuccggggacgacugcguggugaagccccuggacgaccgguucgccagcgcgcucaccgcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagaccgccugccucgggaaguccuacgcgcagauguggacgcugauguacuuccaccgccgggaccugcgccucgccgccaacgccaucugcagcgccguccccucccacugggugcccaccagccggaccaccugguccauccacgcgaagcacgaguggaugaccacggaggacaugcuggccguguggaaccgcgucuggauccaggagaacccguggauggaggacaagacccccguggagagcugggaggaggugcccuaccugggcaagcgcgaggaccaguggugcgggagccucaucggccugaccucccgggccaccugggccaagaacauccagacggcgaucaaccagguccgcagccugaucgggaacgaggaguacaccgacuacaugcccuccaugaagcgguuccgcaaggaggaggaggaggccggcgugcucugguga

SEQ ID NO: 9455 - RNA, 9876 nt, Artificial Sequence
  derived and/or modified CDS sequence (opt1) from DENV-2__EU482733__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaccacccaggaguccgagagcaacauccuggacaucgaccuccgcccggccuccgccuggacgcuguacgccguggccaccaccuucgucacccccaugcugcggcacagcaucgagaacuccagcgugaacgugucccucacggcgaucgccaaccaggccaccguccugauggggcugggccgcggguggccccucagcaagauggacaucggcgugccccugcuggccaucgggugcuacucccaggugaacccgaucacccucaccgcggcccugcugcuccuggucgcccacuacgccaucaucggccccggccugcaggccaaggcgacgcgcgaggcccagaagcgggccgccgccgggaucaugaagaaccccaccguggacggcaucaccgugaucgaccucgagcccaucccguacgaccccaaguucgagaagcagcuggggcaggucaugcugcucgugcugugcgugacccagguccugaugaugcgcacgaccugggcgcucugcgaggcccugacccuggccaccggccccaucagcacgcucugggaggggaaccccggccgguucuggaacaccaccaucgccguguccauggccaacaucuuccgcggcagcuaccuggcgggggccggccuccucuucuccaucaugaagaacaccacgaacacccggcgcgggaccggcaacaucggcgagacccugggggagaaguggaagucccggcugaacgcccucggcaaguccgaguuccagaucuacaagaaguccgggauccaggagguggaccgcacgcuggccaaggagggcaucaagcgcggggagaccgaccaccacgcggucucccgcggcagcgccaagcugcggugguucguggagcgcaacauggugaccccggagggcaaggucguggaccucgggugcggccgcggcgggugguccuacuacugcggcgggcugaagaacgugcgcgaggucaaggggcugaccaagggcgggcccgggcacgaggagcccauccccaugagcacguacggcuggaaccucgugcggcugcagagcgggguggacgucuucuucaccccgcccgagaagugcgacacccugcucugcgacaucggcgaguccagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgccaccgggaacaucguguccagcgugaacaugaucucccgcaugcugaucaaccgguucacgaugaagcacaagaaggcgaccuacgagccggacgucgaccucggcagcgggacccgcaacaucggcaucgagaacgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggugaacggggugguccgccugcucaccaagcccugggacguggugccgauggucacgcagauggccaugaccgacaccacccccuucggccagcagcggguguucaaggagaagguggacacgcgcacccaggagcccaaggagggcaccaagaagcugaugcggaucaccgccgaguggcuguggaaggagcucgggaagaagaagacgccccgcaugugcacccgggaggaguucacccgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagacgugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggcgcgauguacgccgacgacaccgccgggugggacacccggaucacccuggaggaccucaagaacgaggagauggugacgaaccacaugaagggcgagcacaagaagcuggccgaggccaucuucaagcugaccuaccagaacaaggugguccgcgugcagcgcccgacgccccgggggaccgugauggacaucaucucccgcaaggaccagcggggcagcggccaggucgggacguacggccucaacaccuucaccaacauggaggcgcagcugauccgccagauggagggggagggcaucuucaaguccauccagcggcugaccgugacggaggagaucgccgugcagaacuggcucgcccgcgucggccgggagcgccugagccggauggccaucuccggggacgacugcguggugaagccccuggacgaccgcuucgccagcgcgcucaccgcccugaacgacaugggcaagguccggaaggacauccagcagugggagcccucccgcggguggaacgacuggacccaggugccguucugcagccaccacuuccacgagcuggugaugaaggacggccggguccucguggugcccugccgcaaccaggacgagcugaucgggcgggcccgcaucucccagggcgccggcuggagccugaaggagaccgccugccucgggaaguccuacgcgcagauguggacgcugauguacuuccaccggcgcgaccugcggcucgccgccaacgccaucugcagcgccguccccucccacugggugcccaccagccgcaccaccugguccauccacgcgaagcacgaguggaugaccacggaggacaugcuggccguguggaaccgcgucuggauccaggagaacccguggauggaggacaagacccccguggagagcugggaggaggugcccuaccugggcaagcgggaggaccaguggugcgggagccucaucggccugaccucccgcgccaccugggccaagaacauccagacggcgaucaaccagguccggagccugaucgggaacgaggaguacaccgacuacaugcccuccaugaagcgcuuccggaaggaggaggaggaggccggcgugcucugguga

SEQ ID NO: 9456 - RNA, 9876 nt, Artificial Sequence
  derived and/or modified CDS sequence (opt1) from DENV-2__EU482734__SS-prME
accgccggcgugaucgucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucaugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucgggggcguguucaccuccguggggaaggcccuccaccaggucuucggcgcgaucuacggcgccgccuucagcgggguguccuggaccaugaagauccugaucggcgugaucaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggcccugaagaucgucaagaacauggagaaguaccagcucgccgugaccaucauggccaucuccugcgugccgaacgcggucauccugcagaacgccuggaaggugagcugcacgauccuggccgccguguccgucagcccccuccugcugaccuccagccagcagaaggcggacuggaucccccucgcccugaccaucaagggccugaaccccaccgccaucuuccucacgacccugucccgcaccagcaagaagcgguccuggccgcugaacgaggccaucauggccgugggcauggucagcauccucgcguccagccugcugaagaacgacauccccaugaccgggccccucguggccggcgggcugcugacggugugcuacguccucaccggccgcagcgccgaccuggagcuggagcgggccgccgacgugaagugggaggaccaggcggagaucuccgggagcucccccauccucagcaucaccaucuccgaggacggcagcauguccauccgcaacgaggaggaggagcagacccugacgauccugauccggaccggccuccuggugaucagcggggucuucccgguguccauccccgugaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacaccauguggcacgugacgcgcggggccguccucaugcaccgcggcaagcggaucgagcccagcugggccgacgugaagaaggaccugguguccuacgggggcggcuggaagcuggagggggaguggaaggagggcgaggagguccaggugcucgcgcuggagcccgggaagaacccccgcgccgugcagaccaagcccggcaucuucaagaccaacaccgggacgaucggcgccgucagccuggacuucucccccggcaccagcgggucccccaucguggaccggaagggcaagguggucgggcucuacggcaacggcguggugacccgcagcggggccuacgucuccgcgaucgcccagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggcgccgacccgcguggucgccgccgagauggaggaggcccuccgggggcugcccauccgcuaccagacgcccgccauccgggcggagcacaccggccgcgagaucguggaccugaugugccacgccaccuucaccaugcggcuccugagccccgugcgcgucccgaacuacaaccugaucaucauggacgaggcccacuucacggaccccgccuccaucgccgcgcggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugacggacuucaaggggaagaccgucugguucgugccguccaucaaggccggcaacgacaucgccgccugccuccgcaagaacggcaagaaggugauccagcugagccggaagaccuucgacuccgaguacgucaagacccgcgccaacgacugggacuucguggugacgaccgacaucagcgagaugggggcgaacuucaaggccgagcgggucaucgacccccgccggugcaugaagcccgugauccugaccgacggcgaggagcgcgugauccucgccgggcccaugccggucacccacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacgcccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuacaagguggcggccgagggcaucaacuacgccgaccgccgguggugcuucgacgggaucaagaacaaccagauccuggaggagaacguggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucacggagauggggcgccugcccaccuucaugacccagaaggcccggaacgcccuggacaaccucgcggugcugcacaccgccgaggccggcgggaaggccuacaaccacgcccugagcgagcuccccgagacgcuggagacccugcuccugcugacccuccuggcgaccgucacgggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucacggugguggccgccaccauggccaacgagaugggguuccuggagaagaccaagaaggaccugggccucggcagcaucaccacgcaggagagcgaguccaacauccuggacaucgaccugcggccggccagcgcguggacccucuacgccgucgccaccaccuucgugacgcccaugcugcgccacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacccugacggccgcccuccugcugcucguggcgcacuacgccaucaucggccccggccugcaggccaaggccacccgggaggcccagaagcgcgcggccgccgggaucaugaagaaccccaccguggacggcaucaccgucaucgaccuggagcccaucccguacgaccccaaguucgagaagcagcucgggcaggucaugcugcugauccucugcgugacgcagguccugaugaugcggaccaccugggcccugugcgaggcccucacccuggcgacgggccccaucuccacccugugggaggggaaccccggccgcuucuggaacaccaccaucgccgugagcauggccaacaucuuccgcggcuccuaccucgccggggcgggccugcuguucagcaucaugaagaacacgaccaacacccggcgcgggaccggcaacaucggcgagacgcucggggagaaguggaagucccggcugaacgcccugggcaagagcgaguuccagaucuacaagaaguccgggauccaggagguggaccgcacccucgccaaggagggcaucaagcgcggggagaccgaccaccacgccgucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugacgaagggcggccccgggcacgaggagcccaucaccauguccaccuacggcuggaaccuggugcggcuccagagcgggguggacgucuucuucacgccgcccgagaagugcgacacgcugcugugcgacaucggcgagagcucccccaaccccaccaucgaggcgggccgcacccuccgggugcugaaccugguggagaacuggcucaacaacaacacccaguucugcaucaagguccugaaccccuacaugcccagcgugaucgagaagauggagacccugcagcgcaaguacgggggcgcccucgugcggaacccccugucccgcaacagcacgcacgagauguacugggucuccaacgccaccgggaacaucgugagcuccgugaacaugaucagccggaugcugaucaaccgcuucaccaugaagcacaagaaggccaccuacgagcccgacgucgaccugggcuccgggacgcggaacaucggcaucgagagcgagaucccgaaccucgacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggugaacggggugguccgccugcugaccaagcccugggacguggugcccauggucacccagauggccaugaccgacacgaccccguucggccagcagcggguguucaaggagaagguggacacccgcacccaggagcccaaggagggcacgaagaagcucaugaagaucaccgccgaguggcuguggaaggagcuggggaagaagaagacgccccggaugugcacccgcgaggaguucacgcggaagguccgcagcaacgccgcccucggcgcgaucuucaccgacgagaacaaguggaaguccgcccgggaggccguggaggacgggcgcuucugggagcugguggaccgggagcgcaaccugcaccucgagggcaagugcgagaccugcgucuacaacaugauggggaagcgggagaagaagcugggcgaguucggcaaggccaaggggagccgcgcgaucugguacauguggcugggcgcccgguuccucgaguucgaggcccugggguuccugaacgaggaccacugguucucccgcggcaacagccucagcgggguggagggcgagggccugcaccggcugggguacauccuccgcgacgucuccaagaaggagggcggggccauguacgccgacgacaccgcgggcugggacacgcggaucacccuggaggaccugaagaacgaggagauggugaccaaccacaugaagggggagcacaagaagcucgccgaggccaucuucaagcugaccuaccagaacaaggugguccgcgugcagcggcccacgccgcgcggcaccgugauggacaucaucagccggcgcgaccagcgcggcuccgggcaggucggcaccuacgggcugaacaccuucacgaacauggaggcccagcucauccggcagauggagggcgagggcaucuucaagagcauccagcaccugaccgugaccgaggagaucgccgugcagaacuggcuggcgcgcgucgggcgggagcgccucucccggauggccaucagcggcgacgacugcguggugaagcccaucgacgaccgcuucgccuccgcccugaccgcccugaacgacauggggaagguccggaaggacauccagcagugggagcccagccgcggcuggaacgacuggacccaggugcccuucugcucccaccacuuccacgagcucgugaugaaggacgggcggguccugguggugccgugccgcaaccaggacgagcugaucggccgggcgcgcaucagccagggcgccggguggucccucaaggagaccgccugccugggcaagagcuacgcccagauguggacccugauguacuuccaccggcgcgaccuccggcuggccgcgaacgccaucugcuccgccguccccagccacugggugcccaccucccgcaccacguggagcauccacgccaagcacgaguggaugaccaccgaggacaugcuggcgguguggaaccgggucuggauccaggagaaccccuggauggaggacaagaccccgguggaguccugggaggaggugcccuaccucgggaagcgcgaggaccaguggugcggcagccugaucgggcugacgagccgggccaccugggccaagaacauccagaccgccaucaaccagguccgcucccucaucggcaacgaggaguacaccgacuacaugcccagcaugaagcgcuuccggcgcgaggaggaggaggccggcgugcugugguga

SEQ ID NO: 9457 - RNA, 9876 nt, Artificial Sequence
  derived and/or modified CDS sequence (opt1) from DENV-2__EU482735__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucaugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucgggggcguguucaccuccguggggaaggcccuccaccaggucuucggcgcgaucuacggcgccgccuucagcgggguguccuggaccaugaagauccugaucggcgugaucaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggcccugaagaucgucaagaacauggagaaguaccagcucgccgugaccaucauggccaucuccugcgugccgaacgcggucauccugcagaacgccuggaaggugagcugcacgauccuggccgccguguccgucagcccccuccugcugaccuccagccagcagaaggcggacuggaucccccucgcccugaccaucaagggccugaaccccaccgccaucuuccucacgacccugucccgcaccagcaagaagcgguccuggccgcugaacgaggccaucauggccgugggcauggucagcauccucgcguccagccugcugaagaacgacauccccaugaccgggccccucguggccggcgggcugcugacggugugcuacguccucaccggccgcagcgccgaccuggagcuggagcgggccgccgacgugaagugggaggaccaggcggagaucuccgggagcucccccauccucagcaucaccaucuccgaggacggcagcauguccauccgcaacgaggaggaggagcagacccugacgauccugauccggaccggccuccuggugaucagcggggucuucccgguguccauccccgugaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacaccauguggcacgugacgcgcggggccguccucaugcaccgcggcaagcggaucgagcccagcugggccgacgugaagaaggaccugguguccuacgggggcggcuggaagcuggagggggaguggaaggagggcgaggagguccaggugcucgcgcuggagcccgggaagaacccccgcgccgugcagaccaagcccggcaucuucaagaccaacaccgggacgaucggcgccgucagccuggacuucucccccggcaccagcgggucccccaucguggaccggaagggcaagguggucgggcucuacggcaacggcguggugacccgcagcggggccuacgucuccgcgaucgcccagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggcgccgacccgcguggucgccgccgagauggaggaggcccuccgggggcugcccauccgcuaccagacgcccgccauccgggcggagcacaccggccgcgagaucguggaccugaugugccacgccaccuucaccaugcggcuccugagccccgugcgcgucccgaacuacaaccugaucaucauggacgaggcccacuucacggaccccgccuccaucgccgcgcggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugacggacuucaaggggaagaccgucugguucgugccguccaucaaggccggcaacgacaucgccgccugccuccgcaagaacggcaagaaggugauccagcugagccggaagaccuucgacuccgaguacgucaagacccgcgccaacgacugggacuucguggugacgaccgacaucagcgagaugggggcgaacuucaaggccgagcgggucaucgacccccgccggugcaugaagcccgugauccugaccgacggcgaggagcgcgugauccucgccgggcccaugccggucacccacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacgcccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuacaagguggcggccgagggcaucaacuacgccgaccgccgguggugcuucgacgggaucaagaacaaccagauccuggaggagaacguggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucacggagauggggcgccugcccaccuucaugacccagaaggcccggaacgcccuggacaaccucgcggugcugcacaccgccgaggccggcgggaaggccuacaaccacgcccugagcgagcuccccgagacgcuggagacccugcuccugcugacccuccuggcgaccgucacgggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucacggugguggccgccaccauggccaacgagaugggguuccuggagaagaccaagaaggaccugggccucggcagcaucaccacgcaggagagcgaguccaacauccuggacaucgaccugcggccggccagcgcguggacccucuacgccgucgccaccaccuucgugacgcccaugcugcgccacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacccugacggccgcccuccugcugcucguggcgcacuacgccaucaucggccccggccugcaggccaaggccacccgggaggcccagaagcgcgcggccgccgggaucaugaagaaccccaccguggacggcaucaccgucaucgaccuggagcccaucccguacgaccccaaguucgagaagcagcucgggcaggucaugcugcugauccucugcgugacgcagguccugaccaugcggaccaccugggcccugugcgaggcccucacgcuggcgaccggccccaucuccacccugugggaggggaaccccggccgcuucuggaacaccacgaucgccgugagcauggccaacaucuuccgcggcuccuaccucgccggggcgggccugcuguucagcaucaugaagaacaccaccaacacccggcgcgggacgggcaacaucggcgagacccucggggagaaguggaagucccggcugaacgcccugggcaagagcgaguuccagaucuacaagaaguccgggauccaggagguggaccgcacccucgccaaggagggcaucaagcgcggggagaccgaccaccacgccgucagccgcggcuccgccaagcugcggugguucguggagcgcaacauggugacgccggagggcaaggucguggaccuggggugcggccgcgggggcuggagcuacuacugcgggggccucaagaacgugcgcgaggucaagggccugaccaagggcggccccgggcacgaggagcccauccccauguccaccuacggcuggaaccuggugcggcuccagagcgggguggacgucuucuucaccccgcccgagaagugcgacacgcugcugugcgacaucggcgagagcucccccaaccccaccaucgaggcgggccgcacccuccgggugcugaaccugguggagaacuggcucaacaacaacacccaguucugcaucaagguccugaacccguacaugcccagcgugaucgagaagauggagacccugcagcgcaaguacgggggcgcccucgugcggaacccccugucccgcaacagcacgcacgagauguacugggucuccaacgccaccgggaacaucgugagcuccgugaacaugaucagccggaugcugaucaaccgcuucaccaugaagcacaagaaggccaccuacgagccggacgucgaccugggcuccgggacgcggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggugaacggggugguccgccugcugaccaagcccugggacguggugccgauggucacccagauggccaugaccgacacgacccccuucggccagcagcggguguucaaggagaagguggacacccgcacccaggagcccaaggagggcacgaagaagcucaugaagaucaccgccgaguggcuguggaaggagcuggggaagaagaagacgccccggaugugcacccgcgaggaguucacgcggaagguccgcagcaacgccgcccucggcgcgaucuucaccgacgagaacaaguggaaguccgcccgggaggccguggaggacgggcgcuucugggagcugguggaccgggagcgcaaccugcaccucgagggcaagugcgagaccugcgucuacaacaugauggggaagcgggagaagaagcugggcgaguucggcaaggccaaggggagccgcgcgaucugguacauguggcugggcgcccgguuccucgaguucgaggcccugggguuccugaacgaggaccacugguucucccgcggcaacagccucagcgggguggagggcgagggccugcaccggcugggguacauccuccgcgacgucuccaagaaggagggcggggccauguacgccgacgacaccgcgggcugggacacgcggaucacccuggaggaccugaagaacgaggagauggugaccaaccacaugaagggggagcacaagaagcucgccgaggccaucuucaagcugaccuaccagaacaaggugguccgcgugcagcggccgacgccccgcggcaccgugauggacaucaucagccggcgcgaccagcgcggcuccgggcaggucggcaccuacgggcugaacaccuucacgaacauggaggcccagcucauccggcagauggagggcgagggcaucuucaagagcauccagcaccugaccgugaccgaggagaucgccgugcagaacuggcuggcgcgcgucgggcgggagcgccucucccggauggccaucagcggcgacgacugcguggugaagcccaucgacgaccgcuucgccuccgcccugaccgcccugaacgacauggggaagguccggaaggacauccagcagugggagcccagccgcggcuggaacgacuggacccaggugccguucugcucccaccacuuccacgagcucgugaugaaggacgggcggguccugguggugcccugccgcaaccaggacgagcugaucggccgggcgcgcaucagccagggcgccggguggucccucaaggagaccgccugccugggcaagagcuacgcccagauguggacccugauguacuuccaccggcgcgaccuccggcuggccgcgaacgccaucugcuccgccguccccagccacugggugcccaccucccgcaccacguggagcauccacgccaagcacgaguggaugaccaccgaggacaugcuggcgguguggaaccgggucuggauccaggagaacccguggauggaggacaagacccccguggaguccugggaggaggugcccuaccucgggaagcgcgaggaccaguggugcggcagccugaucgggcugacgagccgggccaccugggccaagaacauccagaccgccaucaaccagguccgcucccucaucggcaacgaggaguacaccgacuacaugcccagcaugaagcgcuuccggcgcgaggaggaggaggccggcgugcugugguga

SEQ ID NO: 9458 - RNA, 9876 nt, Artificial Sequence
  derived and/or modified CDS sequence (opt1) from DENV-2__EU482736__SS-prME
accgcgggggucaucaucaugcugauccccaccgcgauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccgcaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggucguguccuucgugacccugaucacggggaacaugagcuuccgggaccucggccgcgucauggugauggugggggccaccaugaccgacgacaucggcaugggcaucaccuaccuggcccugcucgccgcguucaagguccgccccacguucgccgccgggcugcugcuccggaagcugaccuccaaggagcugaugauggccaccaucggcaucgcccuccugagccaguccaccauccccgagacgauccuggagcucaccgacgcgcuggcccugagcaugauggugcucaagaucgugcgcaacauggagaaguaccagcuggccgucaccaucauggccaucuccugcgugccgaacgccgugauccugcagaacgcguggaaggucagcugcaccauccucgccgccguguccgucagcccccugcugcucacguccagccagcagaaggccgacuggaucccccuggcgcugaccaucaaggggcucaaccccaccgccaucuuccugaccacgcugucccggaccagcaagaagcgcuccuggccgcucaacgaggccaucauggccgugggcauggugagcauccuggccagcucccugcucaagaacgacauccccaugaccggcccccuggucgccggcgggcugcucaccgugugcuacgugcugacggggcggagcgccgaccuggagcucgagcgcgccgccgacgucaagugggaggaccaggccgagaucuccgggagcucccccauccugagcaucaccaucuccgaggacgggagcauguccaucaagaacgaggaggaggagcagacccugaccauccucauccggacgggccugcuggugaucagcggcguguucccggucuccauccccaucaccgcggccgccugguaccucugggaggugaagaagcagcgcgccggggugcugugggacguccccagcccgccgcccgugggcaaggccgagcuggaggacggggcguaccggaucaagcagcgcggcauccucggguacucccagaucggcgccggcguguacaaggaggggaccuuccacaccauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagacgaagcccggccucuucaagaccaacaccggcaccaucggggccgucagccuggacuucucccccggcacgagcggcucccccaucguggaccggaaggggaagguggucggccuguacgggaacggcguggugacccgcagcggcgccuacgucagcgccaucgcgcagaccgagaaguccaucgaggacaaccccgagaucgaggacgacaucuuccggaagaagcgccucaccaucauggaccugcaccccggggccggcaagacgaagcgguaccugcccgccaucgugcgcgaggccaucaagcgggggcugcgcacccucauccuggccccgacccgcguggucgcggccgagauggaggaggcccugcggggccuccccauccgcuaccagacccccgccauccgggccgagcacacggggcgcgagaucguggaccugaugugccacgcgaccuucaccaugcggcugcucagccccgugcgcgucccgaacuacaaccugaucaucauggacgaggcccacuucaccgaccccgccuccaucgccgcccggggcuacaucagcacgcgcguggagaugggcgaggcggccgggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggucugguucgugccguccaucaaggcggggaacgacaucgccgccugccugcgcaagaacggcaagaaggugauccagcucagccggaagaccuucgacuccgaguacgucaagacccgcgccaacgacugggacuucguggugaccacggacaucagcgagaugggcgccaacuucaaggcggagcgggucaucgacccccgccggugcaugaagcccgugauccugaccgacggggaggagcgcgugauccuggccggccccaugccggucacccacuccagcgccgcccagcggcgcgggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccguccauguucgagcccgagcgcgagaagguggacgccaucgacggcgaguaccggcuccgcggggaggcccggaagacguucguggaccugaugcgccggggcgaccugcccgucuggcucgccuaccgcguggccgcggaggggaucaacuacgccgaccggcgcuggugcuucgacggcaucaagaacaaccagauccuggaggagaacguggaggucgagaucuggaccaaggagggggagcggaagaagcugaagccgcgcuggcucgacgcccggaucuacagcgacccccuggcccugaaggaguucaaggaguucgcggccggccgcaagucccucacccugaaccugaucaccgagaugggccggcuccccacguucaugacccagaaggcccgcgacgcccuggacaaccuggccgugcuccacaccgcggaggccgggggccgggccuacaaccacgcccugagcgagcugcccgagacccucgagacgcugcugcuccugacccugcucgccaccgucaccgggggcaucuuccuguuccugauguccggcaaggggaucggcaagaugacgcucgggaugugcugcaucaucaccgcgagcauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugaccgugguggcggccacgauggccaacgagaugggcuuccucgagaagaccaagaaggaccuggggcugggcuccaucgccacccaggagagcgaguccaacauccucgacaucgaccugcggccggccagcgcguggacccuguacgccgucgccacgaccuucgugacccccaugcuccgccacuccaucgagaacagcuccgugaacgucagccugaccgccaucgcgaaccaggccacggugcugaugggccucgggaagggcuggccccuguccaagauggacaucggggugccccugcucgccaucggcugcuacagccaggucaacccgaucacccugaccgccgcccugcuccugcugguggcgcacuacgccaucaucgggcccggccuccaggccaaggccacccgggaggcccagaagcgcgcggccgccggcaucaugaagaaccccacgguggacgggaucaccgucaucgaccuggagcccaucccguacgaccccaaguucgagaagcagcugggccaggugaugcuccugauccugugcgugacccagguccucaugaugcgcaccacgugggcccugugcgaggcccugacccucgcgaccgggcccaucuccacccugugggagggcaaccccgggcgguucuggaacacgaccaucgccgugagcauggccaacaucuuccgcggcuccuaccuggccggcgcggggcuccuguucagcaucaugaagaacaccaccaacacgcggcgcggcaccgggaacaucggcgagacccugggcgagaaguggaagucccggcucaacgcccugggcaagagcgaguuccagaucuacaagaaguccggcauccaggagguggaccgcacccuggccaaggaggggaucaagcggggcgagacggaccaccacgccgucagccgcggguccgccaagcuccggugguucguggagcgcaacauggugaccccggagggcaaggucguggaccugggcugcgggcggggcggguggagcuacuacugcggcgggcugaagaacgugcgcgaggucaagggccucaccaagggcgggcccggccacgaggagcccauccccaugagcaccuacggguggaaccuggugcggcugcaguccggcguggacgucuucuucacgccgcccgagaagugcgacacccuccugugcgacaucggggagagcucccccaaccccaccaucgaggcgggccgcacccugcgggugcucaaccugguggagaacuggcugaacaacaacacgcaguucugcaucaagguccucaacccguacaugcccagcgugaucgagaagauggagacccugcagcgcaaguacggcggggcccuggugcggaacccccugucccgcaacagcacccacgagauguacugggucuccaacgccaccggcaacaucgugagcuccgugaacaugaucagccggaugcucaucaaccgcuucaccaugaagcacaagaaggccacguacgagccggacgucgaccugggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgcgagcuccauggugaacggcgugguccgccuccugaccaagcccugggacguggugccgauggucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaagguccgcagcaacgccgcccugggggcgaucuucaccgacgagaacaaguggaaguccgcccgggaggccguggaggacagccgcuucugggagcucaucgaccgggagcgcaaccugcaccuggagggcaagugcgagaccugcguguacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcggcaacagccuguccggggucgagggcgaggggcuccaccggcugggcuacauccugcgcgacgugagcaagaaggagggcggggccauguacgccgacgacacggcgggcugggacacccggaucacccucgaggaccugaagaacgaggagauggucaccaaccacaugaagggggagcacaagaagcuggccgaggccaucuucaagcucacguaccagaacaagguggugcgcguccagcggccgacgccccgcggcaccgugauggacaucaucucccgccgggaccagcgcgggagcggccaggugggcaccuacgggcugaacacguucaccaacauggaggcccagcugauccggcagauggagggcgaggggaucuucaaguccauccagcaccucaccgucaccgaggagaucgccgugcagaacuggcuggcgcgcgugggccgggagcgccugagccggauggccaucuccggcgacgacugcgucgugaagccccucgacgaccgcuucgccagcgcccugacggcccugaacgacauggggaaggugcggaaggacauccagcagugggagcccucccgcggcuggaacgacuggacccaggucccguucugcagccaccacuuccacgagcucgugaugaaggacgggcgggugcuggucgugcccugccgcaaccaggacgagcugaucggccgggcgcgcaucucccagggggccggcuggagccucaaggagaccgccugccugggcaaguccuacgcccagauguggacccugauguacuuccaccggcgcgaccuccggcuggccgcgaacgccaucugcagcgccgugcccucccacuggguccccacgagccgcaccaccuggagcauccacgccaagcacgaguggaugaccaccgaggacaugcuggcgguguggaaccggguguggauccaggagaacccguggauggaggacaagacgcccgucgaguccugggaggaggugcccuaccucgggaagcgcgaggaccaguggugcggcagccugaucgggcugaccucccgcgccaccugggccaagaacauccagaccgccaucaaccaggugcggagccucaucggcaacgaggaguacacggacuacaugcccuccaugaagcgcuuccggcgcgaggaggaggaggccgggguccugugguga

SEQ ID NO: 9459 - RNA, 9876 nt, Artificial Sequence
  derived and/or modified CDS sequence (opt1) from DENV-2__EU482737__SS-prME
accgcgggggugaucgugaugcugauccccaccgcgauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccauggucgaccggggcugggggaacggcugcggccucuucggcaagggcgggaucgugaccugcgcgauguucacgugcaagaagaacauggagggcaaggugguccugcccgagaaccuggaguacaccaucgugaucacgccccacagcggggaggagcacgccgugggcaacgacaccgggaagcacggcaaggagaucaagaucaccccgcaguccagcaucaccgaggccgagcucaccggguacggcacggucaccauggagugcagcccccgcaccggccuggacuucaacgagauggugcugcuccagauggaggacaaggccuggcuggugcaccggcagugguuccuggaccucccccugcccuggcugccgggggccgacacccagggcagcaacuggauccagaaggagacgcucgucaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccucgagaagcggcacgugcuggggcgccugaucaccgucaacccgaucguggcggagaaggacagccccgugaacaucgaggccgagccgcccuucggcgacuccuacaucaucaucggggucgagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccagguguucggcgccaucuacggcgccgccuucagcggggucuccuggaccaugaagauccugaucggcgugaucaucaccuggaucgggaugaacagccgcuccacgagccuguccgugagccucguccuggugggcguggucacccuguaccucggggcgauggugcaggccgacuccggcugcguggucagcuggaaguccaaggagcugaagugcggcagcgggaucuucaucaccgacaacgugcacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggucaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgagguggaggacuacggcuucgggguguucaccacgaacaucuggcugaagcugcgcgagaagcaggacgucuucugcgacagcaagcucauguccgccgcgaucaaggacaaccgggccgugcacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgucacggccgggcacggccagaucgacaacuucagccugggcgugcuggggauggcccucuuccuggaggagaugcugcggacccgcgugggcaccaagcacgccaugcuccuggucgugguguccuucgucacccugaucacggggaacaugagcuuccgggaccucggccgcgugauggugauggucggggccaccaugaccgacgacaucggcaugggcaucaccuaccuggcccugcucgccgcguucaaggugcgccccacguucgccgccgggcugcugcuccggaagcugaccuccaaggagcugaugauggccaccaucggcaucgcccuccugagccaguccaccauccccgagacgauccuggagcucaccgacgcgcuggcccugagcaugauggugcucaagaucguccgcaacauggagaaguaccagcuggccgugaccaucauggccaucuccugcgugccgaacgccgucauccugcagaacgcguggaaggugagcugcaccauccucgccgccgucuccgugagcccccugcugcucacguccagccagcagaaggccgacuggaucccccuggcgcugaccaucaaggggcucaaccccaccgccaucuuccugaccacgcugucccggaccagcaagaagcgcuccuggccgcucaacgaggccaucauggccgugggcauggucagcauccuggccagcucccugcucaagaacgacauccccaugaccggcccccugguggccggcgggcugcucaccgugugcuacguccugacggggcggagcgccgaccuggagcucgagcgcgccgccgacgugaagugggaggaccaggccgagaucuccgggagcucccccauccugagcaucaccaucuccgaggacgggagcauguccaucaagaacgaggaggaggagcagacccugaccauccucauccggacgggccugcuggugaucagcggcgucuucccgguguccauccccaucaccgcggccgccugguaccucugggaggugaagaagcagcgcgccgggguccugugggacgugcccagcccgccgcccgugggcaaggccgagcuggaggacggggcguaccggaucaagcagcgcggcauccucggguacucccagaucggcgccggcgucuacaaggaggggaccuuccacaccauguggcacgugacccggggcgccgugcugaugcaccgcgggaagcggaucgagcccagcugggccgacgucaagaaggaccugaucuccuacggcgggggcuggaagcucgagggcgaguggaaggagggggaggagguccaggugcuggcccuggagcccggcaagaacccccgcgcgguccagacgaagcccggccucuucaagaccaacaccggcaccaucggggccgugagccuggacuucucccccggcacgagcggcucccccaucguggaccggaaggggaaggucgugggccuguacgggaacggcguggucacccgcagcggcgccuacgugagcgccaucgcgcagaccgagaaguccaucgaggacaaccccgagaucgaggacgacaucuuccggaagaagcgccucaccaucauggaccugcaccccggggccggcaagacgaagcgguaccugcccgccaucgugcgcgaggccaucaagcgggggcugcgcacccucauccuggccccgacccgcgucguggcggccgagauggaggaggcccugcggggccuccccauccgcuaccagacccccgccauccgggccgagcacacggggcgcgagaucguggaccugaugugccacgcgaccuucaccaugcggcugcucagccccguccgcgugccgaacuacaaccugaucaucauggacgaggcccacuucaccgaccccgccuccaucgccgcccggggcuacaucagcacgcgcguggagaugggcgaggcggccgggaucuucaugaccgccacgccgcccggcucccgggacccguucccccagagcaacgcccccaucauggacgaggagcgcgagauccccgagcgguccuggaacagcgggcacgagugggucaccgacuucaagggcaagacggugugguucgugccguccaucaaggcggggaacgacaucgccgccugccugcgcaagaacggcaagaaggucauccagcucagccggaagaccuucgacuccgaguacgugaagacccgcgccaacgacugggacuucguggucaccacggacaucagcgagaugggcgccaacuucaaggcggagcgggugaucgacccccgccggugcaugaagcccgugauccugaccgacggggaggagcgcgucauccuggccggccccaugccggugacccacuccagcgccgcccagcggcgcgggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccguccauguucgagcccgagcgcgagaagguggacgccaucgacggcgaguaccggcuccgcggggaggcccggaagacguucgucgaccugaugcgccggggcgaccugcccguguggcucgccuaccgcguggccgcggaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacagcgacccccuggcccugaaggaguucaaggaguucgcggccggccgcaagucccucacccugaaccugaucaccgagaugggccggcuccccacguucaugacccagaaggcccgcgacgcccuggacaaccuggccguccuccacaccgcggaggccgggggccgggccuacaaccacgcccugagcgagcugcccgagacccucgagacgcugcugcuccugacccugcucgccaccgugaccgggggcaucuuccuguuccugauguccggcaaggggaucggcaagaugacgcucgggaugugcugcaucaucaccgcgagcauccugcugugguacgcccagauccagccgcacuggaucgccgccagcaucauccucgaguucuuccugaucgugcugcucauccccgagcccgagaagcagcgcacgccccaggacaaccagcugaccuacgucgugaucgccauccugaccguggucgcggccacgauggccaacgagaugggcuuccucgagaagaccaagaaggaccuggggcugggcuccaucgccacccaggagagcgaguccaacauccucgacaucgaccugcggccggccagcgcguggacccuguacgccguggccacgaccuucgugacccccaugcuccgccacuccaucgagaacagcuccgucaacgugagccugaccgccaucgcgaaccaggccacggugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacccgggaggcccagaagcgcgcggccgccggcaucaugaagaaccccacggucgacgggaucaccgugaucgaccuggagcccaucccguacgaccccaaguucgagaagcagcugggccaggugaugcuccugauccugugcgucacccaggugcucaugaugcgcaccacgugggcccugugcgaggcccugacccucgcgaccgggcccaucuccacccugugggagggcaaccccgggcgguucuggaacacgaccaucgccgugagcauggccaacaucuuccgcggcuccuaccuggccggcgcggggcuccuguucagcaucaugaagaacaccaccaacacgcggcgcggcaccgggaacaucggcgagacccugggcgagaaguggaagucccggcucaacgcccugggcaagagcgaguuccagaucuacaagaaguccggcauccaggaggucgaccgcacccuggccaaggaggggaucaagcggggcgagacggaccaccacgccgugagccgcggguccgccaagcuccggugguucguggagcgcaacauggucaccccggagggcaaggugguggaccugggcugcgggcggggcggguggagcuacuacugcggcgggcugaagaacguccgcgaggugaagggccucaccaagggcgggcccggccacgaggagcccauccccaugagcaccuacggguggaaccuggugcggcugcaguccggcgucgacguguucuucacgccgcccgagaagugcgacacccuccugugcgacaucggggagagcucccccaaccccaccaucgaggcgggccgcacccugcgggugcucaaccuggucgagaacuggcugaacaacaacacgcaguucugcaucaaggugcucaacccguacaugcccagcgugaucgagaagauggagacccugcagcgcaaguacggcggggcccugguccggaacccccugucccgcaacagcacccacgagauguacuggguguccaacgccaccggcaacaucgugagcuccgucaacaugaucagccggaugcucaucaaccgcuucaccaugaagcacaagaaggccacguacgagccggacguggaccugggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgcgagcuccauggugaacggcgucgugcgccuccugaccaagcccugggacguggucccgauggugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagacgccccggaugugcacgcgcgaggaguucacccggaaggugcgcagcaacgccgcccugggggcgaucuucaccgacgagaacaaguggaaguccgcccgggaggccguggaggacagccgcuucugggagcucaucgaccgggagcgcaaccugcaccuggagggcaagugcgagaccugcgucuacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcggcaacagccuguccgggguggagggcgaggggcuccaccggcugggcuacauccugcgcgacgucagcaagaaggagggcggggccauguacgccgacgacacggcgggcugggacacccggaucacccucgaggaccugaagaacgaggagauggugaccaaccacaugaagggggagcacaagaagcuggccgaggccaucuucaagcucacguaccagaacaaggugguccgcgugcagcggccgacgccccgcggcaccgugauggacaucaucucccgccgggaccagcgcgggagcggccaggucggcaccuacgggcugaacacguucaccaacauggaggcccagcugauccggcagauggagggcgaggggaucuucaaguccauccagcaccucaccgugaccgaggagaucgccgugcagaacuggcuggcgcgcgucggccgggagcgccugagccggauggccaucuccggcgacgacugcguggugaagccccucgacgaccgcuucgccagcgcccugacggcccugaacgacauggggaagguccggaaggacauccagcagugggagcccucccgcggcuggaacgacuggacccaggugccguucugcagccaccacuuccacgagcucgugaugaaggacgggcggguccugguggugcccugccgcaaccaggacgagcugaucggccgggcgcgcaucucccagggggccggcuggagccucaaggagaccgccugccugggcaaguccuacgcccagauguggacccugauguacuuccaccggcgcgaccuccggcuggccgcgaacgccaucugcagcgccguccccucccacugggugcccacgagccgcaccaccuggagcauccacgccaagcacgaguggaugaccaccgaggacaugcuggcgguguggaaccgggucuggauccaggagaacccguggauggaggacaagacgcccguggaguccugggaggaggugcccuaccucgggaagcgcgaggaccaguggugcggcagccugaucgggcugaccucccgcgccaccugggccaagaacauccagaccgccaucaaccagguccggagccucaucggcaacgaggaguacacggacuacaugcccuccaugaagcgcuuccggcgcgaggaggaggaggccggggugcugugguga

SEQ ID NO: 9460 - RNA, 9876 nt, Artificial Sequence
  derived and/or modified CDS sequence (opt1) from DENV-2__EU482739__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaaccuggagaaguaccagcuggccgucaccaucauggccaucagcugcgugccgaacgccgugauccuccagaacgccuggaaggucuccugcaccauccuggcggccgugagcgucagcccccugcuccugacgagcucccagcagaaggccgacuggaucccccuggcccucaccaucaagggccugaaccccaccgcgaucuuccugaccacgcucagccggaccuccaagaagcgcagcuggccgcugaacgaggccgugauggccgugggcauggucuccauccuggccagcagccuccugaagaacgacauccccaugaccgggccccugguggccggcgggcuccugaccgugugcuacguccugacgggccgguccgcggaccucgagcuggagcgcgccgccgacgugaagugggaggaccaggccgagaucagcggguccagccccauccuguccaucaccaucagcgaggacggcuccaugagcaucaagaacgaggaggaggagcagacccucaccauccugauccggacgggccugcucgugaucuccggggucuucccggugagcauccccaucaccgccgcggccugguaccugugggaggugaagaagcagcgcgccggcguccugugggacgugcccagcccgccgcccguggggaaggccgagcucgaggacggcgccuaccggaucaagcagcgcgggaucuucggcuacagccagaucggcgcgggggucuacaaggagggcaccuuccacaccauguggcacgugacccgcggggccgugcugaugcaccgcggcaagcggaucgagcccuccugggccgacgucaagaaggaccugaucagcuacgggggcggcuggaagcucgagggggaguggaaggagggcgaggagguccaggugcuggcccuggagcccgggaagaacccccgcgccguccagacgaagcccggccucuucaagaccaacaccgggaccaucggcgcggugucccuggacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccucaccaucauggaccugcaccccggcgcggggaagacgaagcgguaccugcccgccaucgugcgcgaggccaucaagcggggccugcgcacccucauccuggccccgacccgcgucguggccgcggagauggaggaggcccugcgggggcuccccauccgcuaccagacccccgccauccgggccgagcacacgggccgcgagaucguggaccugaugugccacgccaccuucaccaugcggcugcucucccccguccgcgugccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcucucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccugaccgacggcgaggagcgggucauccuggcggggcccaugccggugacccacagcuccgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacgggaucaagaacaaccagauccuggaggagaacgucgagguggagaucuggaccaaggagggcgagcgcaagaagcugaagccgcgguggcucgacgcccgcaucuacuccgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggugggcgggcgcgcguacaaccacgcccuguccgagcugcccgagacccucgagacgcugcugcuccugacccugcucgccaccgugaccggcggcaucuuccuguuccugaugagcgggaagggcaucgggaagaugacgcucggcaugugcugcaucaucaccgccuccauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccacgauggcgaacgagaugggguuccucgagaagaccaagaaggaccugggccugggcagcaucaccacccaggaguccgagagcaacauccucgacaucgaccugcgcccggccuccgccuggacgcuguacgccguggccaccaccuucgucacccccaugcuccggcacagcaucgagaacuccagcgugaacgugucccugacggcgaucgccaaccaggccaccguccugauggggcucggccgcggguggccccugagcaagauggacaucggcgugccccugcucgccaucgggugcuacucccaggugaacccgaucacccugaccgcggcccugcuccugcuggucgcccacuacgccaucaucggccccggccuccaggccaaggcgacgcgcgaggcccagaagcgggccgccgccgggaucaugaagaaccccaccguggacggcaucaccgugaucgaccuggagcccaucccguacgaccccaaguucgagaagcagcuggggcaggucaugcuccuggugcugugcgugacccagguccucaugaugcgcacgaccugggcgcugugcgaggcccugacccucgccaccggccccaucagcacgcugugggaggggaaccccggccgguucuggaacaccaccaucgccguguccauggccaacaucuuccgcggcagcuaccuggcgggggccggccuccuguucuccaucaugaagaacaccacgaacacccggcgcgggaccggcaacaucggcgagacccugggggagaaguggaagucccggcucaacgcccugggcaaguccgaguuccagacguacaagaaguccgggauccaggagguggaccgcacccuggccaaggagggcaucaagcgcggggagaccgaccaccacgcggucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucacgaagggcgggcccgggcacgaggagcccauccccaugagcaccuacggcuggaaccuggugcggcugcagagcgggguggacgucuucuucaccccgcccgagaagugcgacacccuccugugcgacaucggcgaguccagccccaaccccacgaucgaggccggccgcacccugcgggugcucaaccugguggagaacuggcugaacaacaacacccaguucugcaucaagguccucaacccguacaugcccuccgugaucgagaagauggagacccugcagcgcaaguacgggggcgcccuggugcggaacccccugagccgcaacuccacccacgagauguacugggucagcaacgccacggggaacaucguguccagcgugaacaugaucucccgcaugcucaucaaccgguucaccaugaagcacaagaaggcgaccuacgagccggacgucgaccugggcagcgggacccgcaacaucggcaucgagaacgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggugguccgccuccugacgaagcccugggacguggugccgauggucacccagauggccaugaccgacaccacgcccuucggccagcagcggguguucaaggagaagguggacacccgcacccaggagcccaaggagggcaccaagaagcugaugcggaucacggccgaguggcucuggaaggagcuggggaagaagaagacgccccggaugugcacccgggaggaguucacccgcaagguccggagcaacgcggcccugggcgccaucuucacggacgagaacaaguggaaguccgcccgcgaggccguggaggacagccgguucugggagcucgucgaccgcgagcggaaccugcaccuggaggggaagugcgagaccugcguguacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggggaacagccuguccggcguggagggggagggccuccacaagcugggcuacauccugcgcgacgucagcaagaaggagggcggcgcgauguacgccgacgacaccgccgggugggacacccggaucacgcucgaggaccugaagaacgaggagauggugaccaaccacaugaagggcgagcacaagaagcuggccgaggccaucuucaagcucaccuaccagaacaaggugguccgcgugcagcgcccgacgccccgggggacggugauggacaucaucucccgcaaggaccagcggggcagcggccaggucgggaccuacggccugaacaccuucaccaacauggaggcgcagcugauccgccagauggagggggagggcaucuucaaguccauccagcaccucacggugaccgaggagaucgccgugcagaacuggcuggcccgggucggccgcgagcggcugagccgcauggccaucuccggggacgacugcguggugaagccccucgacgaccgguucgccagcgcgcugaccgcccugaacgacaugggcaagguccgcaaggacauccagcagugggagcccucccggggguggaacgacuggacccaggugccguucugcagccaccacuuccacgagcucgugaugaaggacggccgcguccugguggugcccugccggaaccaggacgagcugaucgggcgcgcccggaucucccagggcgccggcuggagccucaaggagacggccugccuggggaaguccuacgcgcagauguggacccugauguacuuccaccgccgggaccuccgccuggccgccaacgccaucugcagcgccguccccucccacugggugcccaccagccggaccaccugguccauccacgcgaagcacgaguggaugacgaccgaggacaugcuggccguguggaaccgcgucuggauccaggagaacccguggauggaggacaagacccccguggagagcugggaggaggugcccuaccucggcaagcgcgaggaccaguggugcgggagccugaucggccugaccucccgggccacgugggccaagaacauccagaccgcgaucaaccagguccgcagccucaucgggaacgaggaguacaccgacuacaugcccuccaugaagcgguuccgcaaggaggaggaggaggccggcgugcugugguga

SEQ ID NO: 9461 - RNA, 9876 nt, Artificial Sequence
  derived and/or modified CDS sequence (opt1) from DENV-2__EU482740__SS-prME
accgccggggugaucaucaugcugauccccaccgccauggcguuccaccucaccacccgcaacggggagccccacaugaucgucgggcggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaaguccaaggagcugaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgacaucaaggggaucaugcagccgggcaagcggucccugcgcccccagcccaccgagcucaaguacagcuggaagaccuggggcaaggccaagaugcuguccacggagagccacaaccagaccuuccugaucgacgggccggagaccgcggagugccccaacaccaaccgggccuggaacucccucgaggucgaggacuacggcuucgggguguucacgaccaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggccggugagccagcacaacuaccgccccggcuaccacacccagacggccgggcccuggcaccugggcaagcuggagauggacuucgacuucugcgaggggaccaccgugguggucaccgaggacugcggcaaccggggccccagccuccgcacgaccaccgcguccgggaagcugaucaccgaguggugcugccggagcugcacgcugccgccccuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacccgcgugggcaccaagcacgccauccuccugguggcggucuccuucgugacgcugaucaccgggaacaugagcuuccgggaccucggccgcgugauggucauggugggggccaccaugaccgacgacaucggcaugggcgugacguaccuggcccugcucgccgccuucaagguccgccccaccuucgcggccgggcugcugcuccggaagcugaccuccaaggagcugaugauggccaccaucggcaucgcccuccugagccaguccacgaucccggagaccauccuggagcucaccgacgcccuggcgcuggggaugauggugcucaagaucgugcgcaacauggagaaguaccagcuggccgucaccaucauggccaucagcugcgugcccaacgccgugauccugcagaacgccuggaaggucuccugcacgauccucgcgguggucagcgugagcccccugcugcucaccagcucccagcagaaggccgacuggaucccccuggcccugaccaucaagggccucaacccgaccgccaucuuccugacgacccugagccggaccuccaagaagcgcagcuggccccucaacgaggcgaucauggccgugggcauggucuccauccuggccagcagccugcucaagaacgacauccccaugaccgggccccugguggccggcgggcugcucacggugugcuacguccugaccggccgguccgccgaccuggagcucgagcgcgcggccgacgugaagugggaggaccaggccgagaucagcggguccagcccgauccuguccaucaccaucagcgaggacggcuccaugagcaucaagaacgaggaggaggagcagacccugacgauccucauccggaccggccugcuggugaucuccggggucuuccccgugagcauccccaucaccgccgccgcgugguaccucugggaggugaagaagcagcgcgccggcguccugugggacgugcccuccccgccgcccguggggaaggccgagcuggaggacggcgccuaccggaucaagcagcgcgggauccucggcuacagccagaucggcgccggggucuacaaggagggcaccuuccacaccauguggcacgugacgcgcggggcggugcugaugcaccgcggcaagcggaucgagccguccugggccgacgucaagaaggaccugaucagcuacgggggcggcuggaagcucgagggggaguggaaggagggcgaggagguccaggugcuggcccuggagcccgggaagaacccccgcgccguccagaccaagcccggccucuucaagaccaacaccgggacgaucggcgccgugucccuggacuucagcccgggcaccuccgggagccccaucguggaccggaagggcaaggucguggggcuguacggcaacggcguggucacccgcuccggggcguacgugagcgccaucgcccagaccgagaaguccaucgaggacaaccccgagaucgaggacgacaucuuccggaagaagcgccucacgaucauggaccugcaccccggcgccgggaagaccaagcgguaccugccggcgaucgugcgcgaggccaucaagcggggccugcgcacccucauccuggcccccacccgcgucguggccgccgagauggaggaggcgcugcgggggcuccccauccgcuaccagacgcccgccauccgggccgagcacaccggccgcgagaucguggaccugaugugccacgccaccuucaccaugcggcugcucuccccgguccgcgugcccaacuacaaccugaucaucauggacgaggcccacuucacggaccccgcgagcaucgccgcccggggcuacaucuccacccgcguggagaugggggaggccgccggcaucuucaugaccgcgacgccgcccgggagccgggaccccuucccccaguccaacgcccccaucauggacgaggagcgcgagauccccgagcggagcuggaacuccggccacgagugggucacggacuucaaggggaagaccgugugguucgugcccagcaucaaggccggcaacgacaucgccgcgugccugcgcaagaacggcaagcgggucauccagcucucccgcaagaccuucgacagcgaguacgugaagacccgggccaacgacugggacuucguggucacgaccgacaucuccgagaugggggccaacuucaaggccgagcgcgugaucgacccccggcgcugcaugaagcccgugauccugaccgacggcgaggagcgggucauccuggccgggccgaugcccgugacccacagcuccgcggcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacgccggagggcaucauccccagcauguucgagcccgagcgggagaagguggacgccaucgacggggaguaccgccuccggggcgaggcgcgcaagaccuucgucgaccugaugcggcgcggggaccugccgguguggcucgccuaccggguggccgccgagggcaucaacuacgccgaccgccgguggugcuucgacgggaucaagaacaaccagauccuggaggagaacgucgagguggagaucuggaccaaggagggcgagcgcaagaagcugaagccccgguggcucgacgcgcgcaucuacuccgacccccuggcccugaaggaguucaaggaguucgccgccggccgcaagagccucacccugaaccugaucacggagauggggcgccuccccaccuucaugacccagaaggcgcgggacgcccuggacaaccuggccguccuccacaccgccgaggccggcgggcgcgcguacaaccacgcccuguccgagcugccggagacgcucgagacccugcugcuccugacccugcucgccaccgugacgggcggcaucuuccuguuccugaugagcgggaagggcaucgggaagaugacccucggcaugugcugcaucaucaccgccuccauccugcugugguacgcccagauccagccccacuggaucgcggccagcaucauccucgaguucuuccugaucgugcugcucauccccgagcccgagaagcagcggaccccgcaggacaaccagcugaccuacgucgugaucgccauccugacgguggucgccgccaccauggcgaacgagaugggguuccucgagaagaccaagaaggaccugggccugggcagcaucaccacgcaggaguccgagagcaacauccucgacaucgaccugcgccccgccuccgccuggacccuguacgccguggccaccaccuucgugacgcccaugcuccggcacagcaucgagaacuccagcgucaacgugucccugaccgcgaucgccaaccaggccaccgugcugauggggcucggcaagggguggccccugagcaagauggacaucggcgucccgcugcucgccaucgggugcuacucccaggugaaccccaucacccugacggcggcccugcuccugcugguggcccacuacgccaucaucggccccggccuccaggccaaggcgacccgcgaggcccagaagcgcgccgccgccgggaucaugaagaaccccaccgucgacggcaucaccgugaucgaccuggagccgauccccuacgaccccaaguucgagaagcagcugggccaggugaugcuccugauccugugcgucacccaggugcucaugaugcggaccaccugggcgcugugcgaggcccugacccucgccacgggccccaucagcacccugugggaggggaacccgggccgcuucuggaacaccaccaucgccguguccauggccaacaucuuccggggcagcuaccuggcgggggccggccuccuguucuccaucaugaagaacacgaccaacacccgccgggggaccggcaacaucggcgagacgcugggggagaaguggaagucccgccucaacgcccugggcaaguccgaguuccagaucuacaagaaguccgggauccaggaggucgaccggacccuggccaaggagggcaucaagcgcggggagaccgaccaccacgcggugucccggggcagcgccaagcuccgcugguucguggagcggaacauggucacccccgagggcaaggugguggaccuggggugcggccgcgggggcugguccuacuacugcgggggccugaagaacguccgggaggugaagggccucacgaagggcgggcccgggcacgaggagcccaucccgaugagcaccuacggcuggaaccuggugcgccugcagagcggggucgacguguucuucacgccgcccgagaagugcgacacccuccugugcgacaucggcgaguccagccccaacccgacgaucgaggccggccggacccugcgcgugcucaaccuggucgagaacuggcugaacaacaacacccaguucugcgugaaggugcucaaccccuacaugcccuccgucaucgagaagauggagacccugcagcggaaguacgggggcgcccuggugcgcaacccgcugagccggaacuccacccacgagauguacugggugagcaacgccacggggaacaucgucuccagcgugaacaugaucucccgcaugcucaucaaccgcuucaccaugaagcacaagaaggcgaccuacgagcccgacguggaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggucaacgggguggugcggcuccugacgaagccgugggacgucgugcccauggugacccagauggccaugaccgacaccacgcccuucggccagcagcgcgucuucaaggagaagguggacacccggacccaggagcccaaggagggcaccaagaagcugaugaagaucacggccgaguggcucuggaaggagcuggggaagaagaagaccccgcgcaugugcacccgggaggaguucacccgcaaggugcgguccaacgcggcccugggcgccaucuucacggacgagaacaaguggaaguccgcccgcgaggccgucgaggacucccgguucugggagcucaucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucagccgggggaacucccugagcggcgucgagggggagggccuccaccgccugggcuacauccugcgggacguguccaagaaggagggcggggcgauguacgccgacgacaccgccgggugggacacccgcaucacgcucgaggaccugaagaacgaggagauggugaccaaccacaugaagggcgagcacaagaagcuggccgaggccaucuucaagcucaccuaccagaacaaggucgugcgggugcagcgccccacgccccgggggacggucauggacaucaucagccggcgcgaccagcggggcuccggccagguggggaccuacggccugaacaccuucaccaacauggaggcgcagcugauccgccagauggagggggagggcaucuucaagagcauccagcaccucacggugaccgaggagaucgccguccagaacuggcuggcccgggugggccgcgagcggcugucccgcauggccaucagcggggacgacugcguggucaagccccucgacgaccgguucgccuccgcgcugaccgcccugaacgacaugggcaaggugcgcaaggacauccagcagugggagccgagccggggguggaacgacuggacccaggugcccuucugcucccaccacuuccacgagcucgucaugaaggacggccgcgugcuggugguccccugccggaaccaggacgagcugaucgggcgcgcccggaucagccagggcgccggcuggucccucaaggagacggccugccugggcaagagcuacgcgcagauguggacccugauguacuuccaccgccgggaccuccgccuggccgccaacgccaucugcuccgccgugcccagccacugggugccgaccucccggaccaccuggagcauccacgcgaagcacgaguggaugacgaccgaggacaugcuggccgucuggaaccgcguguggauccaggagaaccccuggauggaggacaagacccccguggagagcugggaggagguccccuaccucggcaagcgcgaggaccaguggugcgggucccugaucggccugaccagccgggccacgugggccaagaacauccagaccgcgaucaaccaggugcgcucccucaucgggaacgaggaguacaccgacuacaugccgagcaugaagcgguuccgccgggaggaggaggaggccggcgugcugugguga

SEQ ID NO: 9462 - RNA, 9876 nt, Artificial Sequence
  derived and/or modified CDS sequence (opt1) from DENV-2__EU482741__SS-prME
accgcgggggucaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccgcaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggucguguccuucgugacccugaucacggggaacaugagcuuccgggaccucggccgcgucauggugauggugggggccaccaugaccgacgacaucggcaugggcaucaccuaccuggcccugcucgccgcguucaagguccgccccacguucgccgccgggcugcugcuccggaagcugaccuccaaggagcugaugauggccaccaucggcaucgcccuccugagccaguccaccauccccgagacgauccuggagcucaccgacgcgcuggcccuggggaugauggugcucaagaucgugcgcaacauggagaaguaccagcuggccgucaccaucauggccaucagcugcgugccgaacgccgugauccugcagaacgcguggaaggucuccugcaccauccucgccgccgugagcgucagcccccugcugcucacgagcucccagcagaaggccgacuggaucccccuggcgcugaccaucaagggccucaaccccaccgccaucuuccugaccacgcugagccggaccuccaagaagcgcagcuggccgcucaacgaggccaucauggccgugggcaugguguccauccuggccagcagccugcucaagaacgacauccccaugaccgggccccuggucgcgggcgggcugcucaccgugugcuacgugcugacgggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacagccagaucggcgccggcguguacaaggaggggaccuuccacaccauguggcacgucacccggggcgccgugcugaugcaccgcgggaagcggaucgagcccuccugggccgacgugaagaaggaccugaucagcuacggcgggggcuggaagcucgagggcgaguggaaggagggggaggagguccaggugcuggcccuggagcccggcaagaacccccgcgcggugcagacgaagcccggccucuucaagaccaacaccggcaccaucggggccgucucccuggacuucagccccggcacguccggcagccccaucguggaccggaaggggaagguggucggccuguacgggaacggcguggugacccgcuccggcgccuacgucagcgccaucgcgcagaccgagaaguccaucgaggacaaccccgagaucgaggacgacaucuuccggaagaagcgccucaccaucauggaccugcaccccggggccggcaagacgaagcgguaccugcccgccaucgugcgcgaggccaucaagcgggggcugcgcacccucauccuggccccgacccgcguggucgcggccgagauggaggaggcccugcggggccuccccauccgcuaccagacccccgccauccgggccgagcacacggggcgcgagaucguggaccugaugugccacgcgaccuucaccaugcggcugcucucccccgugcgcgucccgaacuacaaccugaucaucauggacgaggcccacuucaccgaccccgccagcaucgccgcccggggcuacaucuccacgcgcguggagaugggcgaggcggccgggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggucugguucgugccgagcaucaaggcggggaacgacaucgccgccugccugcgcaagaacggcaagaaggugauccagcucucccggaagaccuucgacagcgaguacgucaagacccgcgccaacgacugggacuucguggugaccacggacaucuccgagaugggcgccaacuucaaggcggagcgggucaucgacccccgccggugcaugaagcccgugauccugaccgacggggaggagcgcgugauccuggccggccccaugccggucacccacagcuccgccgcccagcggcgcgggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccgagcauguucgagcccgagcgcgagaagguggacgccaucgacggcgaguaccggcuccgcggggaggcccggaagacguucguggaccugaugcgccggggcgaccugcccgucuggcucgccuaccgcguggccgcggaggggaucaacuacgccgaccggcgcuggugcuucgacggcaucaagaacaaccagauccuggaggagaacguggaggucgagaucuggaccaaggagggggagcggaagaagcugaagccgcgcuggcucgacgcccggaucuacuccgacccccuggcccugaaggaguucaaggaguucgcggccggccgcaagagccucacccugaaccugaucaccgagaugggccggcuccccacguucaugacccagaaggcccgcgacgcccuggacaaccuggccgugcuccacaccgcggaggccgggggccgggccuacaaccacgcccuguccgagcugcccgagacccucgagacgcugcugcuccugacccugcucgccaccgucaccgggggcaucuuccuguuccugaugagcggcaaggggaucggcaagaugacgcucgggaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugaccgugguggcggccacgauggccaacgagaugggcuuccucgagaagaccaagaaggaccuggggcugggcagcaucgccacccaggaguccgagagcaacauccucgacaucgaccugcggccggccuccgcguggacccuguacgccgucgccacgaccuucgugacccccaugcuccgccacagcaucgagaacuccagcgugaacgucucccugaccgccaucgcgaaccaggccacggugcugaugggccucgggaagggcuggccccugagcaagauggacaucggggugccccugcucgccaucggcugcuacucccaggucaacccgaucacccugaccgccgcccugcuccugcugguggcgcacuacgccaucaucgggcccggccuccaggccaaggccacccgggaggcccagaagcgcgcggccgccggcaucaugaagaaccccacgguggacgggaucaccgucaucgaccuggagcccaucccguacgaccccaaguucgagaagcagcugggccaggugaugcuccugauccugugcgugacccagguccucaugaugcgcaccacgugggcccugugcgaggcccugacccucgcgaccgggcccaucagcacccugugggagggcaaccccgggcgguucuggaacacgaccaucgccguguccauggccaacaucuuccgcggcagcuaccuggccggcgcggggcuccuguucuccaucaugaagaacaccaccaacacgcggcgcggcaccgggaacaucggcgagacccugggcgagaaguggaagucccggcucaacgcccuggggaaguccgaguuccagaucuacaagaaguccggcauccaggagguggaccgcacccuggccaaggaggggaucaagcggggcgagacggaccaccacgccgucucccgcgggagcgccaagcuccggugguucguggagcgcaacauggugaccccggagggcaaggucguggaccugggcugcgggcggggcgggugguccuacuacugcggcgggcugaagaacgugcgcgaggucaagggccucaccaagggcgggcccggccacgaggagcccauccccaugagcaccuacggguggaaccuggugcggcugcagagcggcguggacgucuucuucacgccgcccgagaagugcgacacccuccugugcgacaucggggaguccagccccaaccccaccaucgaggcgggccgcacccugcgggugcucaaccugguggagaacuggcugaacaacaacacgcaguucugcaucaagguccucaacccguacaugcccuccgugaucgagaagauggagacccugcagcgcaaguacggcggggcccuggugcggaacccccugagccgcaacuccacccacgagauguacugggucagcaacgccaccggcaacaucguguccagcgugaacaugaucucccggaugcucaucaaccgcuucaccaugaagcacaagaaggccacguacgagccggacgucgaccuggggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggugaacggcgugguccgccuccugaccaagcccugggacguggugccgauggucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaagguccgcuccaacgccgcccugggggcgaucuucaccgacgagaacaaguggaaguccgcccgggaggccguggaggacucccgcuucugggagcucaucgaccgggagcgcaaccugcaccuggagggcaagugcgagaccugcguguacaacaugauggggaagcgggagaagaagcucggcgaguucgggaaggccaagggcagccgcgcgaucugguacauguggcugggcgcccgguuccuggaguucgaggcccucggguuccugaacgaggaccacugguucagccgcggcaacucccugagcggggucgagggcgaggggcuccaccggcugggcuacauccugcgcgacguguccaagaaggagggcggggccauguacgccgacgacacggcgggcugggacacccggaucacccucgaggaccugaagaacgaggagauggucaccaaccacaugaagggggagcacaagaagcuggccgaggccaucuucaagcucacguaccagaacaagguggugcgcguccagcggccgacgccccgcggcaccgugauggacaucaucagccgccgggaccagcgcggguccggccaggugggcaccuacgggcugaacacguucaccaacauggaggcccagcugauccggcagauggagggcgaggggaucuucaagagcauccagcaccucaccgucaccgaggagaucgccgugcagaacuggcuggcgcgcgugggccgggagcgccugucccggauggccaucagcggcgacgacugcgucgugaagccccucgacgaccgcuucgccuccgcccugacggcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcgcgcaucagccagggggccggcuggucccucaaggagaccgccugccugggcaagagcuacgcccagauguggacccugauguacuuccaccggcgcgaccuccggcuggccgcgaacgccaucugcuccgccgugcccagccacuggguccccacgucccgcaccaccuggagcauccacgccaagcacgaguggaugaccaccgaggacaugcuggcgguguggaaccggguguggauccaggagaacccguggauggaggacaagacgcccgucgagagcugggaggaggugcccuaccucgggaagcgcgaggaccaguggugcggcucccugaucgggcugaccagccgcgccaccugggccaagaacauccagaccgccaucaaccaggugcggucccucaucggcaacgaggaguacacggacuacaugcccagcaugaagcgcuuccggcgcgaggaggaggaggccgggguccugugguga

SEQ ID NO: 9463 - RNA, 9876 nt, Artificial Sequence
  derived and/or modified CDS sequence (opt1) from DENV-2__EU482742__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggcccccgagauccagaugagcagcggcaaccuccuguucacgggccaccugaagugccgccuccggauggacaagcugcagcugaaggggauguccuacagcaugugcaccggcaaguucaagaucgugaaggagaucgccgagacccagcacgggaccaucgugauccgcguccaguacgagggcgacggcucccccugcaagaucccguucgagaucauggaccucgagaagcggcacgugcuggggcgccugaucacggugaaccccaucgucaccgagaaggacagccccgugaacaucgaggcggagcccccguucggcgacuccuacaucaucaucgggguggagcccggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcccugcaccagguguucggcgcgaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggccaugguccaggcggacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucaccccggagcugaaccacauccucagcgagaacgaggugaagcugaccaucaugacgggcgacaucaaggggaucaugcaggccggcaagcggucccugcgcccccagcccaccgagcucaaguacagcuggaagaccuggggcaaggcgaagaugcuguccaccgagagccacaaccagacguuccugaucgacgggccggagaccgccgagugccccaacaccaaccgggccuggaacucccucgaggucgaggacuacggcuucgggguguucaccacgaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggccggugagccagcacaacuaccgccccggcuaccacacccagaccgcggggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugccgccccuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgcgauccuccugguggccgucuccuucgugacccugaucacggggaacaugagcuuccgggaccucggccgcgugauggucauggugggggccaccaugaccgacgacaucggcaugggcgugaccuaccuggcccugcucgccgcguucaagguccgccccacguucgccgccgggcugcugcuccggaagcugaccuccaaggagcugaugauggccaccaucggcaucgcccuccugagccaguccaccaucccggagacgauccuggagcucaccgacgcgcuggcccuggggaugauggugcucaagaucgugcgcaacauggagaaguaccagcuggccgucaccaucauggccaucagcugcgugcccaacgccgugauccugcagaacgcguggaaggucuccugcaccauccucgccgccgugagcgucagcccccugcugcucacgagcucccagcagaaggccgacuggaucccccuggcgcugaccaucaagggccucaacccgaccgccaucuuccugaccacgcugagccggaccuccaagaagcgcagcuggccccucaacgaggccaucauggccgugggcaugguguccauccuggccagcagccugcucaagaacgacauccccaugaccgggccccuggucgcgggcgggcugcucaccgugugcuacgugcugacgggccgguccgccgaccuggagcucgagcgcgccgccgacgucaagugggaggaccaggccgagaucagcggguccagcccgauccuguccaucaccaucagcgaggacggcuccaugagcaucaagaacgaggaggaggagcagacccugaccauccucauccggacgggccugcuggugaucuccgggguguuccccgucagcauccccaucaccgcggccgccugguaccucugggaggugaagaagcagcgcgccggcgugcugugggacguccccuccccgccgcccguggggaaggccgagcuggaggacggcgcguaccggaucaagcagcgcgggauccucggcuacagccagaucggcgccgggguguacaaggagggcaccuuccacaccauguggcacgucacccgcggggccgugcugaugcaccgcggcaagcggaucgagccguccugggccgacgugaagaaggaccugaucagcuacgggggcggcuggaagcucgagggggaguggaaggagggcgaggagguccaggugcuggcccuggagcccgggaagaacccccgcgcggugcagacgaagcccggccucuucaagaccaacaccgggaccaucggcgccgucucccuggacuucagcccgggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugccggccaucgugcgcgaggccaucaagcggggccugcgcacccucauccuggcccccacccgcguggucgcggccgagauggaggaggcccugcgggggcuccccauccgcuaccagacccccgccauccgggccgagcacacgggccgcgagaucguggaccugaugugccacgcgaccuucaccaugcggcugcucuccccggugcgcguccccaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggaccccuucccccaguccaacgcccccaucauggacgaggagcgcgagauccccgagcggagcuggaacuccggccacgagugggugaccgacuucaaggggaagacggucugguucgugcccagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggccgaugcccgucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacaccccggagggcaucauccccagcauguucgagcccgagcgcgagaagguggacgccaucgacggggaguaccggcuccgcggcgaggcccggaagacguucguggaccugaugcgccgcggggaccugccggucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccccgcuggcucgacgcccggaucuacuccgacccccuggcccugaaggaguucaaggaguucgcggccggccgcaagagccucacccugaaccugaucaccgagauggggcggcuccccacguucaugacccagaaggcccgcgacgcccuggacaaccuggccgugcuccacaccgcggaggccggcgggcgggccuacaaccacgcccuguccgagcugccggagacccucgagacgcugcugcuccugacccugcucgccgcggucaccggcggcaucuuccuguuccugaugagcgggaagggcaucgggaagaugacccucggcaugugcugcaucaucacggccuccauccugcugugguacgcccagauccagccccacuggaucgccgccagcaucauccucgaguucuuccugaucgugcugcucauccccgagcccgagaagcagcgcaccccgcaggacaaccagcugaccuacguggucaucgcgauccugaccgugguggccgccaccauggccaacgagaugggguuccucgagaagacgaagaaggaccugggccugggcagcaucaccacccaggaguccgagagcaacauccucgacaucgaccugcggcccgccuccgcguggacccuguacgccgucgccacgaccuucgugacccccaugcuccgccacagcaucgagaacuccagcgugaacgucucccugaccgccaucgcgaaccaggccacggugcugauggggcucggcaagggguggccccugagcaagauggacaucggcgugccgcugcucgccaucgggugcuacucccaggucaaccccaucacccugaccgccgcccugcuccugcugguggcgcacuacgccaucaucggccccggccuccaggccaaggccacccgggaggcccagaagcgcgcggccgccgggaucaugaagaaccccacgguggacggcaucaccgucaucgaccuggagccgauccccuacgaccccaaguucgagaagcagcuggggcaggucaugcuccugauccugugcgugacccagguccucaugaugcgcaccacgugggcccugugcgaggcccugacccucgcgaccggccccaucagcacccugugggaggggaacccgggccgguucuggaacacgaccaucgccguguccauggccaacaucuuccgcggcagcuaccuggccggggcgggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggccaaggagggcaucaagcgcggggagacggaccaccacgccgucucccgcggcagcgccaagcuccggugguucguggagcgcaacauggugacccccgagggcaaggucguggaccuggggugcggccgcggcgggugguccuacuacugcggcgggcugaagaacgugcgcgaggucaaggggcucaccaagggcgggcccgggcacgaggagcccaucccgaugagcaccuacggcuggaaccuggugcggcugcagagcgggguggacgucuucuucacgccgcccgagaagugcgacacccuccugugcgacaucggcgaguccagccccaacccgaccaucgaggcgggccgcacccugcgggugcucaaccugguggagaacuggcugaacaacaacacgcaguucugcaucaagguccucaaccccuacaugcccuccgugaucgagaagauggagacccugcagcgcaaguacgggggcgcccuggugcggaacccgcugagccgcaacuccacccacgagauguacugggucagcaacgccaccgggaacaucguguccagcgugaacaugaucucccggaugcucaucaaccgcuucaccaugaagcacaagaaggccacguacgagcccgacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggugaacggggugguccgccuccugaccaagccgugggacguggugcccauggucacccagauggccaugacggacaccacccccuucggccagcagcggguguucaaggagaagguggacacccgcacgcaggagcccaaggagggcaccaagaagcugaugaagaucaccgccgaguggcucuggaaggagcuggggaagaagaagaccccgcggaugugcacgcgcgaggaguucacccggaagguccgcuccaacgccgcccugggcgcgaucuucaccgacgagaacaaguggaaguccgcccgggaggccguggaggacucccgcuucugggagcucaucgaccgggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgccgacgacacggcggggugggacacccggaucacccucgaggaccugaagaacgaggagauggucaccaaccacaugaagggcgagcacaagaagcuggccgaggccaucuucaagcucacguaccagaacaagguggugcgcguccagcggcccacgccccgggggaccgugauggacaucaucagccgccgggaccagcgcggcuccggccagguggggaccuacggccugaacacguucaccaacauggaggcccagcugauccggcagauggagggggagggcaucuucaagagcauccagcaccucaccgucaccgaggagaucgccgugcagaacuggcuggcgcgcgugggccgggagcgccugucccggauggccaucagcggggacgacugcgucgugaagccccucgacgaccgcuucgccuccgcccugacggcccugaacgacaugggcaaggugcggaaggacauccagcagugggagccgagccgcggguggaacgacuggacccagguccccuucugcucccaccacuuccacgagcucgugaugaaggacggccgggugcuggucgugcccugccgcaaccaggacgagcugaucgggcgggcgcgcaucagccagggcgccggcuggucccucaaggagaccgccugccugggcaagagcuacgcccagauguggacccugauguacuuccaccggcgcgaccuccggcuggccgcgaacgccaucugcuccgccgugcccagccacugggucccgacgucccgcaccaccuggagcauccacgccaagcacgaguggaugaccaccgaggacaugcuggcgguguggaaccggguguggauccaggagaaccccuggauggaggacaagacgcccgucgagagcugggaggaggugcccuaccucggcaagcgcgaggaccaguggugcgggucccugaucggccugaccagccgcgccaccugggccaagaacauccagaccgccaucaaccaggugcggucccucaucgggaacgaggaguacacggacuacaugccgagcaugaagcgcuuccggcgcgaggaggaggaggccggcguccugugguga

SEQ ID NO: 9464 - RNA, 9876 nt, Artificial Sequence
  derived and/or modified CDS sequence (opt1) from DENV-2__EU482744__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaagaacaaggagcugaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucacgaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacccagacggcggggcccuggcaccugggcaagcuggagauggacuucgacuucugcgaggggaccaccgugguggucaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcaccaagcacgcgauccuccugguggccgucagcuucgugacgcugaucaccgggaacauguccuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucgugcgcaacauggagaaguaccagcuggccgucuccaucauggccaucagcugcgugccgaacgccgugauccugcagaacgcguggaaggucuccugcaccauccucgccgccgugagcgucagcccccugcugcucacgagcucccagcagaaggccgacuggaucccccuggcgcugaccaucaagggccucaaccccaccgccaucuuccugaccacgcugagccggaccuccaagaagcgcagcuggccgcucaacgaggccaucauggccgugggcaugguguccauccuggccagcagccugcucaagaacgacauccccaugaccgggccccuggucgcgggcgggcugcucaccgugugcuacgugcugacgggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacagccagaucggcgccgggguguacaaggagggcaccuuccacaccauguggcacgucacccgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagacgaagcccggccucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucucccccgugcgcgucccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagacggucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugaccacggacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagacguucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcgacgcccuggacaaccuggccgugcuccacaccgcggaggccggcgggcgggccuacaaccacgcccuguccgagcugcccgagacccucgagacgcugcugcuccugacccugcucgccaccgucaccggcggcaucuuccuguuccugaugagcgggaagggcaucgggaagaugacgcucggcaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgccauccugaccgugguggcggccacgauggccaacgagaugggguuccucgagaagaccaagaaggaccugggccugggcagcaucaccacccaggaguccgagagcaacauccucgacaucgaccugcggccggccuccgccuggacgcuguacgcggucgccaccaccuucgugacccccaugcuccgccacagcaucgagaacuccagcgugaacgucucccugacggccaucgccaaccaggcgaccgugcugauggggcucggcaagggguggccccugagcaagauggacaucggcgugccccugcucgccaucgggugcuacucccaggucaacccgaucacccugaccgccgcccugcuccugcugguggcccacuacgcgaucaucggccccggccuccaggccaaggccacgcgggaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacccagguccucaugaugcgcacgaccugggcccugugcgaggcccugacccucgccaccggccccaucagcacgcugugggaggggaaccccggccgguucuggaacaccaccaucgcgguguccauggccaacaucuuccgcggcagcuaccuggccggggccggccuccuguucuccaucaugaagaacaccacgaacacccggcgcgggaccggcaacaucggcgagacccugggggagaaguggaagucccggcucaacgcgcugggcaaguccgaguuccagaucuacaagaaguccgggauccaggagguggaccgcacgcuggccaaggagggcaucaagcgcggggagaccgaccaccacgccgucucccgcggcagcgccaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcacguacggcuggaaccuggugcggcugcagagcgggguggacgucuucuucaccccgcccgagaagugcgacacccuccugugcgacaucggcgaguccagccccaaccccaccaucgaggccggccgcacgcugcgggugcucaaccugguggagaacuggcugaacaacaacacccaguucugcaucaagguccucaacccguacaugcccuccgugaucgagaagauggagacccugcagcgcaaguacgggggcgcgcuggugcggaacccccugagccgcaacuccacccacgagauguacugggucagcaacgccaccgggaacaucguguccagcgugaacaugaucucccggaugcucaucaaccgcuucacgaugaagcacaagaaggccaccuacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacggggugguccgccuccugaccaagcccugggacguggugccgauggucacgcagauggcgaugaccgacaccacccccuucggccagcagcggguguucaaggagaagguggacacgcgcacccaggagcccaaggagggcaccaagaagcugaugaagaucaccgccgaguggcucuggaaggagcuggggaagaagaagacgccccggaugugcacccgcgaggaguucacccggaagguccgcuccaacgccgcccugggcgccaucuucaccgacgagaacaaguggaaguccgcgcgggaggccguggaggacucccgcuucugggagcucaucgaccgggagcgcaaccugcaccuggaggggaagugcgagacgugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgccgacgacaccgccgggugggacacccggaucacccucgaggaccugaagaacgaggagauggucacgaaccacaugaagggcgagcacaagaagcuggcggaggccaucuucaagcucaccuaccagaacaagguggugcgcguccagcggccgacgccccgggggaccgugauggacaucaucagccgccgggaccagcgcggcuccggccagguggggacguacggccugaacaccuucaccaacauggaggcccagcugauccggcagauggagggggagggcaucuucaagagcauccagcaccucaccgucacggaggagaucgccgugcagaacuggcuggcccgcgugggccgggagcgccugucccggauggcgaucagcggggacgacugcgucgugaagccccucgacgaccgcuucgccuccgcccugaccgcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucgggcgggcccgcaucagccagggcgcgggcuggucccucaaggagaccgccugccugggcaagagcuacgcccagauguggacgcugauguacuuccaccggcgcgaccuccggcuggccgccaacgcgaucugcuccgccgugcccagccacuggguccccaccucccgcaccaccuggagcauccacgccaagcacgaguggaugaccacggaggacaugcuggccguguggaaccggguguggauccaggagaacccguggauggaggacaagacccccgucgagagcugggaggaggugcccuaccucggcaagcgcgaggaccaguggugcgggucccugaucggccugaccagccgcgcgaccugggccaagaacauccagacggccaucaaccaggugcggucccucaucgggaacgaggaguacaccgacuacaugcccagcaugaagcgcuuccggaaggaggaggaggaggccggcguccugugguga

SEQ ID NO: 9465 - RNA, 9876 nt, Artificial Sequence
  derived and/or modified CDS sequence (opt1) from DENV-2__EU482745__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccgcaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaaguccaaggagcugaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccggaccuuccugaucgacgggcccgagaccgccgagugcccgaacaccaaccgcgccuggaacucccucgaggucgaggacuacggcuucgggguguucacgaccaacaucuggcugaagcugcgggagaagcaggacguguucugcgacagcaagcucauguccgccgccaucaaggacaaccgcgcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccggccgggcuaccacacccagacggcggggcccuggcaccugggcaagcuggagauggacuucgacuucugcgaggggaccaccgugguggucaccgaggacugcggcaaccgcggccccagccuccggacgaccaccgccuccgggaagcugaucaccgaguggugcugccgcagcugcacgcugcccccgcuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccgggugggcaccaagcacgcgauccuccugguggccgucuccuucgugacgcugaucaccgggaacaugagcuuccgcgaccucggccgcgugauggucauggugggggccaccaugaccgacgacaucggcaugggcgugacguaccuggcccugcucgccgcguucaagguccggcccaccuucgccgccgggcugcugcuccgcaagcugaccuccaaggagcugaugauggccaccaucggcaucgcccuccugagccaguccacgauccccgagaccauccuggagcucaccgacgcgcuggcccuggggaugauggugcucaagaucgugcggaacauggagaaguaccagcuggccgucaccaucauggccaucagcugcgugccgaacgccgugauccugcagaacgcguggaaggucuccugcacgauccucgccgccgugagcgucagcccccugcugcucaccagcucccagcagaaggccgacuggaucccccuggcgcugaccaucaagggccucaaccccaccgccaucuuccugacgacccugagccgcaccuccaagaagcggagcuggccgcucaacgaggccaucauggccgugggcaugguguccauccuggccagcagccugcucaagaacgacauccccaugaccgggccccuggucgcgggcgggcugcucacggugugcuacgugcugaccggccgcuccgccgaccuggagcucgagcgggccgccgacgucaagugggaggaccaggccgagaucagcggguccagccccauccuguccaucaccaucagcgaggacggcuccaugagcaucaagaacgaggaggaggagcagacccugacgauccucauccgcaccggccugcuggugaucuccgggguguucccggucagcauccccaucaccgcggccgccugguaccucugggaggugaagaagcagcgggccggcgugcugugggacguccccagcccgccgcccguggggaaggccgagcuggaggacggcgcguaccgcaucaagcagcgggggauccucggcuacagccagaucggcgccgggguguacaaggagggcaccuuccacaccauguggcacgucacgcgcggggccgugcugaugcaccggggcaagcgcaucgagcccuccugggccgacgugaagaaggaccugaucagcuacgggggcggcuggaagcucgagggggaguggaaggagggcgaggagguccaggugcuggcccuggagcccgggaagaacccccgggcggugcagaccaagcccggccucuucaagaccaacaccgggacgaucggcgccgucucccuggacuucagccccggcaccuccgggagccccaucguggaccgcaagggcaagguggucgggcuguacggcaacggcguggugacccgguccggggccuacgucagcgccaucgcgcagaccgagaaguccaucgaggacaaccccgagaucgaggacgacaucuuccgcaagaagcggcucacgaucauggaccugcaccccggcgccgggaagaccaagcgcuaccugcccgccaucgugcgggaggccaucaagcgcggccugcgcacccucauccuggccccgacccggguggucgcggccgagauggaggaggcccugcgcgggcuccccauccgguaccagacgcccgccauccgcgccgagcacaccggccgggagaucguggaccugaugugccacgcgaccuucaccaugcgccugcucucccccgugcgggucccgaacuacaaccugaucaucauggacgaggcccacuucacggaccccgccagcaucgccgcccgcggcuacaucuccacccggguggagaugggggaggcggccggcaucuucaugaccgccacgccgcccgggagccgcgacccguucccccaguccaacgcccccaucauggacgaggagcgggagauccccgagcgcagcuggaacuccggccacgagugggugacggacuucaaggggaagaccgucugguucgugccgagcaucaaggcgggcaacgacaucgccgccugccugcggaagaacggcaagaaggugauccagcucucccgcaagaccuucgacagcgaguacgucaagacccgggccaacgacugggacuucguggugacgaccgacaucuccgagaugggggccaacuucaaggcggagcgcgucaucgacccccggcgcugcaugaagcccgugauccugaccgacggcgaggagcgggugauccuggccgggcccaugccggucacccacagcuccgccgcccagcgccgcggccggaucgggcgcaaccccaagaacgagaacgaccaguacaucuacaugggcgagccccucgagaacgacgaggacugcgcccacuggaaggaggcgaagaugcugcuggacaacaucaacacgcccgagggcaucaucccgagcauguucgagcccgagcgggagaagguggacgccaucgacggggaguaccgccuccggggcgaggcccgcaagaccuucguggaccugaugcggcgcggggaccugcccgucuggcucgccuaccggguggccgcggagggcaucaacuacgccgaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcccugaaggaguucaaggaguucgcggccggccggaagucccucacccugaaccugaucacggagauggggcgccuccccaccuucaugacccagaaggcccgggacgcccuggacaaccuggccgugcuccacaccgcggaggccggcgggcgcgccuacaaccacgcccuguccgagcugcccgagacgcucgagacccugcugcuccugacccugcucgccaccgucacgggcggcaucuuccuguuccugaugagcgggaagggcaucgggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggguuccucgagaagaccaagaaggaccugggccugggcagcaucaccacgaaggaguccgagagcaacauccucgacaucgaccugcgcccggccuccgccuggacccuguacgcggucgccaccaccuucgugacgcccaugcuccggcacagcaucgagaacuccagcgugaacgucucccugaccgccaucgccaaccaggcgaccgugcugauggggcucggcaagggguggccccugagcaagauggacaucggcgugccccugcucgccaucgggugcuacucccaggucaacccgaucacccugacggccgcccugcuccugcugguggcccacuacgcgaucaucggccccggccuccaggccaaggccacccgcgaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacgcagguccucaugaugcggaccaccugggcccugugcgaggcccugacccucgccacgggccccaucagcacccugugggaggggaaccccggccgcuucuggaacaccaccaucgcgguguccauggccaacaucuuccggggcagcuaccuggccggggccggccuccuguucuccaucaugaagaacacgaccaacacccgccgggggaccggcaacaucggcgagacgcugggggagaaguggaagucccgccucaacgcgcugggcaaguccgaguuccagaucuacaagaaguccgggauccaggagguggaccggacccuggccaaggagggcaucaagcgcggggagaccgaccaccacgccgucucccggggcagcgccaagcuccgcugguucguggagcggaacauggugaccccggagggcaaggucguggaccuggggugcggccgcgggggcugguccuacuacugcgggggccugaagaacgugcgggaggucaagggccucacgaagggcgggcccgggcacgaggagcccauccccaugagcaccuacggcuggaaccuggugcgccugcagagcgggguggacgucuucuucaccccgcccgagaagugcgacacccuccugugcgacaucggcgaguccagccccaaccccacgaucgaggccggccggacccugcgcgugcucaaccugguggagaacuggcugaacaacaacacccaguucugcaucaagguccucaacccguacaugcccuccgugaucgagaagauggagacccugcagcggaaguacgggggcgcgcuggugcgcaacccccugagccggaacuccacccacgagauguacugggucagcaacgccacggggaacaucguguccagcgugaacaugaucucccgcaugcucaucaaccgcuucaccaugaagcacaagaaggccaccuacgagccggacgucgaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggugguccggcuccugacgaagcccugggacguggugccgauggucacccagauggcgaugaccgacaccacgcccuucggccagcagcgcguguucaaggagaagguggacacccggacccaggagcccaaggagggcaccaagaagcugaugaagaucacggccgaguggcucuggaaggagcuggggaagaagaagacgccccgcaugugcacccgggaggaguucacccgcaagguccgguccaacgccgcccugggcgccaucuucacggacgagaacaaguggaaguccgcgcgcgaggccguggaggacucccgguucugggagcucaucgaccgcgagcggaaccugcaccuggaggggaagugcgagaccugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucagccgggggaacucccugagcggcgucgagggggagggccuccaccgccugggcuacauccugcgggacguguccaagaaggagggcggggccauguacgccgacgacaccgccgggugggacacccgcaucacgcucgaggaccugaagaacgaggagauggucaccaaccacaugaagggcgagcacaagaagcuggcggaggccaucuucaagcucaccuaccagaacaagguggugcggguccagcgcccgacgccccgcgggacggugauggacaucaucagccggcgcgaccagcggggcuccggccagguggggaccuacggccugaacaccuucaccaacauggaggcccagcugauccgccagauggagggggagggcaucuucaagagcauccagcaccucacggucaccgaggagaucgccgugcagaacuggcuggcccgggugggccgcgagcggcugucccgcauggcgaucagcggggacgacugcgucgugaagccccucgacgaccgguucgccuccgcccugaccgcccugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggaaccaggacgagcugaucgggcgcgcccggaucagccagggcgcgggcuggucccucaaggagacggccugccugggcaagagcuacgcccagauguggacccugauguacuuccaccgccgggaccuccgccuggccgccaacgcgaucugcuccgccgugcccagccacuggguccccaccucccggaccaccuggagcauccacgccaagcacgaguggaugacgaccgaggacaugcuggccguguggaaccgcguguggauccaggagaacccguggauggaggacaagacccccgucgagagcugggaggaggugcccuaccucggcaagcgcgaggaccaguggugcgggucccugaucggccugaccagccgggcgacgugggccaagaacauccagaccgccaucaaccaggugaagucccucaucgggaacgaggaguacaccgacuacaugcccagcaugaagcgcuuccggcgcgaggaggaggaggccggcguccugugguga

SEQ ID NO: 9466 - RNA, 9876 nt, Artificial Sequence
  derived and/or modified CDS sequence (opt1) from DENV-2__EU482746__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccgcaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaaguccaaggagcugaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccggaccuuccugaucgacgggcccgagaccgccgagugcccgaacaccaaccgcgccuggaacucccucgaggucgaggacuacggcuucgggguguucacgaccaacaucuggcugaagcugcgggagaagcaggacguguucugcgacagcaagcucauguccgccgccaucaaggacaaccgcgcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccggccgggcuaccacacccagacggcggggcccuggcaccugggcaagcuggagauggacuucgacuucugcgaggggaccaccgugguggucaccgaggacugcggcaaccgcggccccagccuccggacgaccaccgccuccgggaagcugaucaccgaguggugcugccgcagcugcacgcugcccccgcuccgguaccgcggcgaggacgggugcugguacggcauggagauccggccccugaaggagaaggaggagaaccuggugaacucccucgugaccgccgggcacggccagaucgacaacuucagccugggcguccuggggauggcccucuuccuggaggagaugcugcgcacccgggugggcaccaagcacgcgauccuccugguggccgucuccuucgugacgcugaucaccgggaacaugagcuuccgcgaccucggccgcgugauggucauggugggggccaccaugaccgacgacaucggcaugggcgugacguaccuggcccugcucgccgcguucaagguccggcccaccuucgccgccgggcugcugcuccgcaagcugaccuccaaggagcugaugauggccaccaucggcaucgcccuccugagccaguccacgauccccgagaccauccuggagcucaccgacgcgcuggcccuggggaugauggugcucaagaucgugcggaacauggagaaguaccagcuggccgucaccaucauggccaucagcugcgugccgaacgccgugauccugcagaacgcguggaaggucuccugcacgauccucgccgccgugagcgucagcccccugcugcucaccagcucccagcagaaggccgacuggaucccccuggcgcugaccaucaagggccucaaccccaccgccaucuuccugacgacccugagccgcaccuccaagaagcggagcuggccgcucaacgaggccaucauggccgugggcaugguguccauccuggccagcagccugcucaagaacgacauccccaugaccgggccccuggucgcgggcgggcugcucacggugugcuacgugcugaccggccgcuccgccgaccuggagcucgagcgggccgccgacgucaagugggaggaccaggccgagaucagcggguccagccccauccuguccaucaccaucagcgaggacggcuccaugagcaucaagaacgaggaggaggagcagacccugacgauccucauccgcaccggccugcuggugaucuccgggguguucccggucagcauccccaucaccgcggccgccugguaccucugggaggugaagaagcagcgggccggcgugcugugggacguccccagcccgccgcccguggggaaggccgagcuggaggacggcgcguaccgcaucaagcagcgggggauccucggcuacagccagaucggcgccgggguguacaaggagggcaccuuccacaccauguggcacgucacgcgcggggccgugcugaugcaccggggcaagcgcaucgagcccuccugggccgacgugaagaaggaccugaucagcuacgggggcggcuggaagcucgagggggaguggaaggagggcgaggagguccaggugcuggcccuggagcccgggaagaacccccgggcggugcagaccaagcccggccucuucaagaccaacaccgggacgaucggcgccgucucccuggacuucagccccggcaccuccgggagccccaucguggaccgcaagggcaagguggucgggcuguacggcaacggcguggugacccgguccggggccuacgucagcgccaucgcgcagaccgagaaguccaucgaggacaaccccgagaucgaggacgacaucuuccgcaagaagcggcucacgaucauggaccugcaccccggcgccgggaagaccaagcgcuaccugcccgccaucgugcgggaggccaucaagcgcggccugcgcacccucauccuggccccgacccggguggucgcggccgagauggaggaggcccugcgcgggcuccccauccgguaccagacgcccgccauccgcgccgagcacaccggccgggagaucguggaccugaugugccacgcgaccuucaccaugcgccugcucucccccgugcgggucccgaacuacaaccugaucaucauggacgaggcccacuucacggaccccgccagcaucgccgcccgcggcuacaucuccacccggguggagaugggggaggcggccggcaucuucaugaccgccacgccgcccgggagccgcgacccguucccccaguccaacgcccccaucauggacgaggagcgggagauccccgagcgcagcuggaacuccggccacgagugggugacggacuucaaggggaagaccgucugguucgugccgagcaucaaggcgggcaacgacaucgccgccugccugcggaagaacggcaagaaggugauccagcucucccgcaagaccuucgacagcgaguacgucaagacccgggccaacgacugggacuucguggugacgaccgacaucuccgagaugggggccaacuucaaggcggagcgcgucaucgacccccggcgcugcaugaagcccgugauccugaccgacggcgaggagcgggugauccuggccgggcccaugccggucacccacagcuccgccgcccagcgccgcggccggaucgggcgcaaccccaagaacgagaacgaccaguacaucuacaugggcgagccccucgagaacgacgaggacugcgcccacuggaaggaggcgaagaugcugcuggacaacaucaacacgcccgagggcaucaucccgagcauguucgagcccgagcgggagaagguggacgccaucgacggggaguaccgccuccggggcgaggcccgcaagaccuucguggaccugaugcggcgcggggaccugcccgucuggcucgccuaccggguggccgcggagggcaucaacuacgccgaccgccgguggugcuucgacgggaucaagaacaaccagauccuggaggagaacguggaggucgagaucuggaccaaggagggcgagcgcaagaagcugaagccgcgguggcucgacgcccgcaucuacuccgacccccuggcccugaaggaguucaaggaguucgcggccggccggaagucccucacccugaaccugaucacggagauggggcgccuccccaccuucaugacccagaaggcccgggacgcccuggacaaccuggccgugcuccacaccgcggaggccggcgggcgcgccuacaaccacgcccuguccgagcugcccgagacgcucgagacccugcugcuccugacccugcucgccaccgucacgggcggcaucuuccuguuccugaugagcgggaagggcaucgggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggguuccucgagaagaccaagaaggaccugggccugggcagcaucaccacgcaggaguccgagagcaacauccucgacaucgaccugcgcccggccuccgccuggacccuguacgcggucgccaccaccuucgugacgcccaugcuccggcacagcaucgagaacuccagcgugaacgucucccugaccgccaucgccaaccaggcgaccgugcugauggggcucggcaagggguggccccugagcaagauggacaucggcgugccccugcucgccaucgggugcuacucccaggucaacccgaucacccugacggccgcccugcuccugcugguggcccacuacgcgaucaucggccccggccuccaggccaaggccacccgcgaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacgcagguccucaugaugcggaccaccugggcccugugcgaggcccugacccucgccacgggccccaucagcacccugugggaggggaaccccggccgcuucuggaacaccaccaucgcgguguccauggccaacaucuuccggggcagcuaccuggccggggccggccuccuguucuccaucaugaagaacacgaccaacacccgccgggggaccggcaacaucggcgagacgcugggggagaaguggaagucccgccucaacgcgcugggcaaguccgaguuccagaucuacaagaaguccgggauccaggagguggaccggacccuggccaaggagggcaucaagcgcggggagaccgaccaccacgccgucucccggggcagcgccaagcuccgcugguucguggagcggaacauggugaccccggagggcaaggucguggaccuggggugcggccgcgggggcugguccuacuacugcgggggccugaagaacgugcgggaggucaagggccucacgaagggcgggcccgggcacgaggagcccauccccaugagcaccuacggcuggaaccuggugcgccugcagagcgggguggacgucuucuucaccccgcccgagaagugcgacacccuccugugcgacaucggcgaguccagccccaaccccacgaucgaggccggccggacccugcgcgugcucaaccugguggagaacuggcugaacaacaacacccaguucugcaucaagguccucaacccguacaugcccuccgugaucgagaagauggagacccugcagcggaaguacgggggcgcgcuggugcgcaacccccugagccggaacuccacccacgagauguacugggucagcaacgccacggggaacaucguguccagcgugaacaugaucucccgcaugcucaucaaccgcuucaccaugaagcacaagaaggccaccuacgagccggacgucgaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggugguccggcuccugacgaagcccugggacguggugccgauggucacccagauggcgaugaccgacaccacgcccuucggccagcagcgcguguucaaggagaagguggacacccggacccaggagcccaaggagggcaccaagaagcugaugaagaucacggccgaguggcucuggaaggagcuggggaagaagaagacgccccgcaugugcacccgggaggaguucacccgcaagguccgguccaacgccgcccugggcgccaucuucacggacgagaacaaguggaaguccgcgcgcgaggccguggaggacucccgguucugggagcucaucgaccgcgagcggaaccugcaccuggaggggaagugcgagaccugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucagccgggggaacucccugagcggcgucgagggggagggccuccaccgccugggcuacauccugcgggacguguccaagaaggagggcggggccauguacgccgacgacaccgccgggugggacacccgcaucacgcucgaggaccugaagaacgaggagauggucaccaaccacaugaagggcgagcacaagaagcuggcggaggccaucuucaagcucaccuaccagaacaagguggugcggguccagcgcccgacgccccgcgggacggugauggacaucaucagccggcgcgaccagcggggcuccggccagguggggaccuacggccugaacaccuucaccaacauggaggcccagcugauccgccagauggagggggagggcaucuucaagagcauccagcaccucacggucaccgaggagaucgccgugcagaacuggcuggcccgggugggccgcgagcggcugucccgcauggcgaucagcggggacgacugcgucgugaagccccucgacgaccgguucgccuccgcccugaccgcccugaacgacaugggcaaggugcgcaaggacauccagcagugggagcccagccggggguggaacgacuggacccaggucccguucugcucccaccacuuccacgagcucgugaugaaggacggccgcgugcuggucgugcccugccggaaccaggacgagcugaucgggcgcgcccggaucagccagggcgcgggcuggucccucaaggagacggccugccugggcaagagcuacgcccagauguggacccugauguacuuccaccgccgggaccuccgccuggccgccaacgcgaucugcuccgccgugcccagccacuggguccccaccucccggaccaccuggagcauccacgccaagcacgaguggaugacgaccgaggacaugcuggccguguggaaccgcguguggauccaggagaacccguggauggaggacaagacccccgucgagagcugggaggaggugcccuaccucggcaagcgcgaggaccaguggugcgggucccugaucggccugaccagccgggcgacgugggccaagaacauccagaccgccaucaaccaggugcgcucccucaucgggaacgaggaguacaccgacuacaugcccagcaugaagcgguuccgccgggaggaggaggaggccggcguccugugguga

SEQ ID NO: 9467 - RNA, 9876 nt, Artificial Sequence
  derived and/or modified CDS sequence (opt1) from DENV-2__EU482590__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccguccugggggacaccgccugggacuucggcagccucgggggcguguucaccuccaucgggaaggcccugcaccagguguucggcgcgaucuacggcgccgccuucagcggggucuccuggaccaugaagauccugaucggcgugaucaucacguggaucgggaugaacagccgcuccaccagccuguccgugagccucguccuggugggcguggucacccuguaccucggggccauggugcaggcggacuccggcugcguggucagcuggaagaacaaggagcugaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccgcagcccaccgagcucaaguacuccuggaagaccuggggcaaggcgaagaugcugagcacggagccccacaaccagaccuuccugaucgacgggccggagaccgccgagugccccaacaccaaccgggccuggaacucccucgagguggaggacuacggcuucgggguguucacgaccaacaucuggcugaagcugcgcgagaagcaggacgucuucugcgacagcaagcucauguccgccgccaucaaggacaaccgggcggugcacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggccggugagccagcacaacuaccgccccggcuaccacacccagacggcggggcccuggcaccugggcaagcuggagauggacuucgacuucugcgaggggaccaccguggucgugaccgaggacugcggcaaccggggccccucccuccgcacgaccaccgccagcgggaagcugaucaccgaguggugcugccggagcugcacgcugccgccccuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcgugggcaccaagcacgcgauccuccuggucgccguguccuucgugacgcugaucaccgggaacaugagcuuccgggaccucggccgcgucauggugauggugggggccaccaugaccgacgacaucggcaugggcgucacguaccuggcccugcucgccgcguucaaggugcgccccaccuucgccgccgggcugcugcuccggaagcugaccuccaaggagcugaugauggccaccaucggcaucgcccuccugagccaguccacgaucccggagaccauccuggagcucaccgacgcgcuggcccuggggaugauggugcucaagaucguccgcaacauggagaaguaccagcuggccgugaccaucauggccaucagcugcgugcccaacgccgucauccugcagaacgcguggaagguguccugcacgauccucgccgccgucagcgugagcccccugcugcucaccagcucccagcagaaggccgacuggaucccccuggcgcugaccaucaagggccucaacccgaccgccaucuuccugacgacccugagccggaccuccaagaagcgcagcuggccccucaacgaggccaucauggccgugggcauggucuccauccuggccagcucccugcucaagaacgacauccccaugaccgggccccugguggcgggcgggcugcucacggugugcuacguccugaccggccggagcgccgaccuggagcucgagcgcgccgccgacgugaagugggaggaccaggccgagaucagcggguccagcccgauccuguccaucaccaucagcgaggacggcuccaugagcaucaagaacgaggaggaggagcagacccugacgauccucauccggaccggccugcuggugaucuccggggucuuccccgugagcauccccaucaccgcggccgccugguaccucugggaggugaagaagcagcgcgccggcguccugugggacgugcccuccccgccgcccguggggaaggccgagcuggaggacggcgcguaccggaucaagcagcgcgggauccucggcuacagccagaucggcgccggggucuacaaggagggcaccuuccacaccauguggcacgugacgcgcggggccgugcugaugcaccgcggcaagcggaucgagccguccugggccgacgucaagaaggaccugaucagcuacgggggcggcuggaagcucgagggggaguggaaggagggcgaggagguccaggugcuggcccuggagcccgggaagaacccccgcgcgguccagaccaagcccggccucuucaagaccaacaccgggacgaucggcgccgugucccuggacuucagcccgggcaccuccgggagccccaucguggaccggaagggcaaggucguggggcuguacggcaacggcguggucacccgcuccggggccuacgugagcgccaucgcgcagaccgagaaguccaucgaggacaaccccgagaucgaggacgacaucuuccggaagaagcgccucacgaucauggaccugcaccccggcgccgggaagaccaagcgguaccugccggccaucgugcgcgaggccaucaagcggggccugcgcacccucauccuggcccccacccgcgucguggcggccgagauggaggaggcccugcgggggcuccccauccgcuaccagacgcccgccauccgggccgagcacaccggccgcgagaucguggaccugaugugccacgcgaccuucaccaugcggcugcucagcccgguccgcgugcccaacuacaaccugaucaucauggacgaggcccacuucacggaccccgccagcaucgccgcccggggcuacaucuccacccgcguggagaugggggaggcggccggcaucuucaugaccgccacgccgcccgggagccgggaccccuucccccaguccaacgcccccauccuggacgaggagcgcgagauccccgagcggagcuggaacuccggccacgagugggucacggacuucaaggggaagaccgugugguucgugcccagcaucaaggcgggcaacgacaucgccgccugccuccgcaagaacggcaagaaggucauccagcugucccggaagaccuucgacagcgaguacgugaagacccgcgccaacgacugggacuucguggucacgaccgacaucuccgagaugggggccaacuucaaggcggagcgggugaucgacccccgccggugcaugaagcccgugauccugaccgacggcgaggagcgcgucauccucgccgggccgaugcccgugacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgccggagggcaucauccccagcauguucgagcccgagcgcgagaagguggacgccaucgacggggaguaccggcugcgcggcgaggcccggaagaccuucgucgaccugaugcgccgcggggaccucccgguguggcuggccuaccgcguggccgcggagggcaucaacuacgccgaccggcgcuggugcuucgacgggaucaagaacaaccagauccuggaggagaacgucgagguggagaucuggaccaaggagggcgagcggaagaagcucaagccccgcuggcuggacgcccggaucuacuccgacccccuggcccucaaggaguucaaggaguucgcggccggccgcaagagccugacccugaaccucaucacggagauggggcggcugcccaccuucaugacccagaaggcccgcgacgcccuggacaaccucgccguccugcacaccgcggaggugggcgggcgggccuacaaccacgcccuguccgagcucccggagacgcuggagacccugcuccugcugacccuccuggccaccgugacgggcggcaucuuccuguuccucaugagcgggaagggcaucgggaagaugacccugggcaugugcugcaucaucaccgccuccauccugcucugguacgcgcagauccagccccacuggaucgccgccagcaucauccuggaguucuuccugaucguccuccugauccccgagcccgagaagcagcgcaccccgcaggacaaccagcugaccuacguggugaucgccauccucacggucguggccgcgaccauggccaacgagaugggguuccuggagaagaccaagaaggaccugggccucggcuccaucaccacgcaggagagcgagagcaacauccuggacaucgaccugcggcccgccuccgccuggacccucuacgccguggcgaccaccuucgucacgcccaugcugcgccacagcaucgagaacuccagcgugaacaucucccugaccgccaucgccaaccaggccaccgugcucauggggcugggcaagggguggccccugagcaagauggacaucggcgucccgcuccuggcgaucgggugcuacucccaggugaaccccaucacccugacggccgcccuccugcugcucguggcccacuacgccaucaucggccccggccugcaggcgaaggccacccgggaggcccagaagcgcgccgccgcggggaucaugaagaaccccaccgucgacggcaucaccgugaucgaccuggagccgauccccuacgaccccaaguucgagaagcagcucggccaggugaugcugcugauccucugcgucacccaggugcugaugaugcgcaccaccugggcccugugcgaggcccucacccuggccacgggccccaucagcacccugugggaggggaacccgggccgguucuggaacaccaccaucgccguguccauggcgaacaucuuccgcggcagcuaccucgccggggccggccugcuguucuccaucaugaagaacacgaccaacacccggcgcgggaccggcaacaucggcgagacgcucggggagaaguggaagucccggcugaacgcccugggcaaguccgaguuccagaucuacaagaaguccgggauccaggaggucgaccgcacccucgcgaaggagggcaucaagcgcggggagaccgaccaccacgccgugucccgcggcagcgccaagcugcggugguucguggagcgcaacauggucacccccgagggcaaggugguggaccuggggugcggccgcggcgggugguccuacuacugcggcgggcucaagaacguccgcgaggugaaggggcugacgaagggcgggcccgggcacgaggagcccaucccgaugagcaccuacggcuggaaccuggugcggcuccaguccggggucgacguguucuucacgccgcccgagaagugcgacacccugcugugcgacaucggcgagagcagccccaacccgacgaucgaggccggccgcacccuccgggugcugaaccuggucgagaacuggcucaacaacaacacccaguucugcaucaaggugcugaaccccuacaugcccuccgugaucgagaagauggagacccugcagcgcaaguacgggggcgcccugguccggaacccgcucagccgcaacuccacccacgagauguacugggugagcaacgcgacggggaacaucguguccagcgucaacaugaucucccggaugcugaucaaccgcuucaccaugaagcacaagaaggccaccuacgagcccgacguggaccugggcagcgggacccgcaacaucggcaucgaguccgagauccccaaccucgacaucaucggcaagcggaucgagaagaucaagcaggagcacgagacgagcuggcacuacgaccaggaccaccccuacaagaccugggccuaccacggguccuacgagaccaagcagaccggcagcgccuccagcauggugaacggggucgugcgccugcugacgaagccgugggacgugguccccauggugacccagauggccaugaccgacaccacgcccuucggccagcagcggguguucaaggagaaggucgacacccgcacccaggagcccaaggagggcaccaagaagcucaugaagaucacggcggaguggcuguggaaggagcuggggaagaagaagaccccgcggaugugcacccgcgaggaguucacccggaaggugcgcuccaacgccgcccucggcgccaucuucacggacgagaacaaguggaaguccgcccgggaggcgguggaggacucccgcuucugggagcugaucgaccgggagcgcaaccugcaccucgaggggaagugcgagaccugcgucuacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgggaacagccucagcggcguggagggggagggccugcaccggcugggcuacauccuccgcgacgucuccaagaaggagggcggggccauguacgccgacgacaccgccgggugggacacccggaucacgcuggaggaccugaagaacgaggagauggugaccaaccacaugaagggcgagcacaagaagcucgccgaggcgaucuucaagcugaccuaccagaacaaggugguccgcgugcagcggcccacgccccgggggacggugauggacaucaucagccgccgggaccagcgcggcuccggccaggucgggaccuacggccugaacaccuucaccaacauggaggcccagcucauccggcagauggagggggagggcaucuucaagagcauccagcaccugacggugaccgaggagaucgccgugcagaacuggcuggcccgcgucggccgggagcgccucucccggauggccaucagcggggacgacugcguggugaagccccuggacgaccgcuucgcguccgcccugaccgcccucaacgacaugggcaagguccggaaggacauccagcagugggagccgagccgcggguggaacgacuggacccaggugcccuucugcucccaccacuuccacgagcuggugaugaaggacggccggguccugguggugcccugccgcaaccaggacgagcucaucgggcgggcccgcaucagccagggcgccggcuggucccugaaggagacggcgugccugggcaagagcuacgcccagauguggacccucauguacuuccaccggcgcgaccugcggcuggccgccaacgccaucugcuccgcgguccccagccacugggugccgaccucccgcaccaccuggagcauccacgccaagcacgaguggaugacgaccgaggacaugcucgccguguggaaccgggucuggauccaggagaaccccuggauggaggacaagacccccguggaguccugggaggaggugcccuaccugggcaagcgcgaggaccaguggugcgggagccugaucggccucaccagccgcgccacgugggcgaagaacauccagaccgccaucaaccagguccggucccugaucgggaacgaggaguacaccgacuacaugccgagcaugaagcgcuuccggcgcgaggaggaggaggccggcgugcugugguga

SEQ ID NO: 9468 - RNA, 9876 nt, Artificial Sequence
  derived and/or modified CDS sequence (opt1) from DENV-2__EU482594__SS-prME
accgcgggggucaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccgcaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggccgucuccuucgugacccugaucacggggaacaugagcuuccgggaccucggccgcgugauggucauggugggggccaccaugaccgacgacaucggcaugggcaucaccuaccuggcccugcucgcggccuucaaggugcgccccacguucgccgccgggcugcugcucaagaagcugaccuccaaggagcugaugauggccaccaucggcaucgcgcuccugagccaguccaccauccccgagacgauccuggagcucaccgacgcccuggcccuggggaugaugguccucaagaucgugcggaacauggagaaguaccagcuggccgugaccaucauggccaucagcugcgucccgaacgcggugauccugcagaacgccuggaagguguccugcaccauccucgccgccgucagcgugagcccccugcugcucacgagcucccagcagaaggcggacuggaucccccuggcccugaccaucaagggccucaaccccaccgccaucuuccugaccacgcugagccgcaccuccaagaagcggagcuggccgcucaacgaggccaucauggccgucggcaugguguccauccuggcgagcagccugcucaagaacgacauccccaugaccgggccccugguggccggcgggcugcucaccgucugcuacgugcugacgggccgcuccgccgaccuggagcucgagcgggccgccgacgugaagugggaggaccaggcggagaucagcggguccagccccauccuguccaucaccaucagcgaggacggcuccaugagcaucaagaacgaggaggaggagcagacccugaccauccucauccgcacgggccugcuggucaucuccgggguguucccggugagcauccccaucaccgccgccgccugguaccucugggaggucaagaagcagcgggccggcgugcugugggacgugcccagcccgccgcccgucgggaaggcggagcuggaggacggcgccuaccgcaucaagcagcgggggauccucggcuacagccagaucggcgccgggguguacaaggagggcaccuuccacaccauguggcacgugacccgcggggccguccugaugcaccggggcaagcgcaucgagcccuccugggccgacgugaagaaggaccugaucagcuacgggggcggcuggaagcucgagggggaguggaaggagggcgaggaggugcagguccuggcgcuggagcccgggaagaacccccgggccgugcagacgaagcccggccucuucaagaccaacaccgggaccaucggcgccgugucccuggacuucagccccggcacguccgggagccccaucgucgaccgcaagggcaaggugguggggcuguacggcaacggcgucgugacccgguccggggccuacgugagcgcgaucgcccagaccgagaaguccaucgaggacaaccccgagaucgaggacgacaucuuccgcaagaagcggcucaccaucauggaccugcaccccggcgccgggaagacgaagcgcuaccugcccgccaucguccgggaggccaucaagcgcggccugcggacccucauccuggcgccgacccgcgugguggccgccgagauggaggaggcccugcgcgggcuccccauccgguaccagacccccgccauccgcgcggagcacacgggccgggagaucgucgaccugaugugccacgccaccuucaccaugcgccugcucucccccgugcgggugccgaacuacaaccugaucaucauggacgaggcccacuucaccgaccccgccagcaucgccgcgcgcggcuacaucuccacgcgggucgagaugggggaggccgccggcaucuucaugaccgccacgccgcccgggagccgcgacccguucccccaguccaacgcgcccaucauggacgaggagcgggagauccccgagcgcagcuggaacuccggccacgagugggugaccgacuucaaggggaagacggugugguucgucccgagcaucaaggccggcaacgacaucgccgccugccugcggaagaacggcaagaaggugauccagcucucccgcaagaccuucgacagcgaguacgugaagacccgggccaacgacugggacuucgucgugaccacggacaucuccgagaugggggcgaacuucaaggccgagcgcgugaucgacccccggcgcugcaugaagcccgucauccugaccgagggcgaggagcgggugauccuggccgggcccaugccggugacccacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaaggucgacgccaucgacggggaguaccgccuccggggcgaggcccgcaagacguucguggaccugaugcggcgcggggaccugcccguguggcucgccuaccgggucgcggccgagggcaucaacuacgccgaccgccgguggugcuucgacgggaucaagaacaaccagauccuggaggagaacguggagguggagaucuggaccaaggagggcgagcgcaagaagcugaagccgcgguggcucgacgcccgcaucuacuccgacccccuggcgcugaaggaguucaaggaguucgccgccggccggaagucccucacccugaaccugaucaccgagauggggcgccuccccacguucaugacccagaaggcccgggacgcccuggacaaccuggcgguccuccacaccgccgaggccggcgggcgcgccuacaaccacgcccuguccgagcugcccgagacccucgagacgcugcugcuccugacccugcucgcgaccgugaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucguccugcucauccccgagcccgagaagcagcggacgccccaggacaaccagcugaccuacguggugaucgcgauccugaccgucguggccgccacgauggccaacgagaugggguuccucgagaagaccaagaaggaccugggccugggcagcaucgccacccaggaguccgagagcaacauccucgacaucgaccugcgcccggcguccgccuggacccuguacgccguggccacgaccuucgucacccccaugcuccggcacagcaucgagaacuccagcgugaacgugucccugaccgcgaucgccaaccaggccacgguccugauggggcucggcaagggguggccccugagcaagauggacaucggcgugccccugcucgccaucgggugcuacucccaggugaacccgaucacccugaccgccgcgcugcuccugcuggucgcccacuacgccaucaucggccccggccuccaggccaaggccacccgcgaggcgcagaagcgggccgccgccgggaucaugaagaaccccacgguggacggcaucaccgugaucgaccuggagcccaucccguacgaccccaaguucgagaagcagcuggggcaggucaugcuccugauccugugcgugacccaggugcucaugaugcgcaccacgugggcccugugcgaggcgcugacccucgccaccggccccaucagcacccugugggaggggaaccccggccgcuucuggaacacgaccaucgccgucuccauggccaacaucuuccggggcagcuaccuggcgggggccggccuccuguucuccaucaugaagaacaccaccaacacgcgccgggggaccggcaacaucggcgagacccugggggagaaguggaagucccgccucaacgcccugggcaaguccgaguuccagaucuacaagaaguccgggauccaggagguggaccggacccuggccaaggagggcaucaagcgcggggagacggaccaccacgccgugucccggggcagcgcgaagcuccgcugguucgucgagcggaacauggugaccccggagggcaagguggucgaccuggggugcggccgcgggggcugguccuacuacugcgggggccugaagaacgugcgggaggugaagggccucaccaagggcgggcccgggcacgaggagcccauccccaugagcaccuacggcuggaaccugguccgccugcagagcgggguggacguguucuucacgccgcccgagaagugcgacacccuccugugcgacaucggcgaguccagccccaaccccaccaucgaggccggccggacccugcgcguccucaaccugguggagaacuggcugaacaacaacacgcaguucugcaucaaggugcucaacccguacaugcccuccgucaucgagaagauggagacccugcagcggaaguacgggggcgcccuggugcgcaacccccugagccggaacuccacccacgagauguacugggugagcaacgccaccgggaacaucgucuccagcgugaacaugaucucccgcaugcucaucaaccgguucaccaugaagcacaagaaggccacguacgagccggacguggaccugggcagcgggacccgcaacaucggcaucgaguccgagauccccaaccuggacaucaucggcaagcgcaucgagaagaucaagcaggagcacgagaccagcuggcacuacgaccaggaccaccccuacaagaccugggcguaccacggguccuacgagacgaagcagaccggcagcgccuccagcauggucaacgggguggugcggcuccugaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcucuggaaggagcuggggaagaagaagacgccccgcaugugcacgcgggaggaguucacccgcaaggugcgguccaacgccgcgcugggcgccaucuucaccgacgagaacaaguggaaguccgcccgcgaggccgucgaggacucccgguucugggagcucaucgaccgcgagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucagccgggggaacucccugagcggcguggagggggagggccuccaccgccugggcuacauccugcgggacgucuccaagaaggagggcggggccauguacgcggacgacacggccgggugggacacccgcaucacccucgaggaccugaagaacgaggagauggugaccaaccacaugaagggcgagcacaagaagcuggccgaggccaucuucaagcucacguaccagaacaaggucgugcgggugcagcgcccgacgccccgggggaccgucauggacaucaucagccgccgcgaccagcggggcuccggccagguggggaccuacggccugaacacguucaccaacauggaggcccagcugauccgccagauggagggggagggcaucuucaagagcauccagcaccucaccgugaccgaggagaucgcgguccagaacuggcuggcccgggugggccgcgagcggcugucccgcauggccaucagcggggacgacugcguggucaagccccucgacgaccgguucgccuccgcccugacggcgcugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucgggcgcgcccggaucagccagggcgccggcuggucccucaaggagaccgccugccugggcaagagcuacgcccagauguggacccugauguacuuccaccgccgggaccuccgccuggcggccaacgccaucugcuccgccgugcccagccacugggugcccacgucccggaccaccuggagcauccacgcgaagcacgaguggaugaccaccgaggacaugcuggccgucuggaaccgcguguggauccaggagaacccguggauggaggacaagacgcccguggagagcugggaggagguccccuaccucggcaagcgggaggaccaguggugcgggucccugaucggccugaccagccgcgccaccugggccaagaacauccagaccgccaucaaccaggugcgcucccucaucgggaacgaggaguacacggacuacaugcccagcaugaagcgguuccgccgggaggaggaggaggcgggcgugcugugguga

SEQ ID NO: 9469 - RNA, 9876 nt, Artificial Sequence
  derived and/or modified CDS sequence (opt1) from DENV-2__EU482604__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcgcacgccccaggacaaccagcugaccuacguggucaucgccauccucaccgugguggccgcgaccauggccaacgagaugggguuccuggagaagacgaagaaggaccugggccucggcagcaucaccacccaggagagcgaguccaacauccuggacaucgaccugcggccggccagcgccuggacccucuacgccgucgcgacgaccuucgugacccccaugcugcgccacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccgcccuccugcugcucguggcccacuacgccaucaucggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucuccacccugugggaggggaaccccggccgcuucuggaacacgaccaucgccgugagcauggcgaacaucuuccgcggcuccuaccucgccggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagacggaccaccacgccgucagccgcggcuccgccaagcugcggugguucguggagcgcaacauggugaccccggagggcaaggucguggaccuggggugcggccgcggcggguggagcuacuacugcggcgggcucaagaacgugcgcgaggucaaggggcugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaagguccggagcaacgccgcccucggcgccaucuucaccgacgagaacaaguggaaguccgcccgcgaggcgguggaggacgggcgguucugggagcugguggacaaggagcgcaaccugcaccucgagggcaagugcgagaccugcgucuacaacaugauggggaagcgggagaagaagcugggcgaguucggcaaggccaaggggagccgcgccaucugguacauguggcugggcgcccgguuccucgaguucgaggcgcugggguuccugaacgaggaccacugguucucccgcggcaacagccucagcgggguggagggcgagggccugcaccggcugggguacauccuccgcgacgucggcaagaaggagggcggcgccauguacgccgacgacacggccgggugggacacccggaucacccuggaggaccugaagaacgaggagauggugaccaaccacaugaagggcgagcacaagaagcucgccgaggcgaucuucaagcugacguaccagaacaaggugguccgcgugcagcggccgacgccccgcggcaccgugauggacaucaucucccggcgcgaccagcgcgggagcggccaggucgggaccuacggccugaacacguucaccaacauggaggcccagcucauccggcagauggagggcgaggggaucuucaaguccauccagcaccugaccgccaccgaggagaucgccgugcagaacuggcuggcccgcgugggccgggagcgccucagccggauggcgaucuccggggacgacugcgucgugaagcccaucgacgaccgcuucgccagcgcccugacggcccugaacgacaugggcaaggugcggaaggacauccagcagugggagcccucccgcggguggaacgacuggacccaggucccguucugcagccaccacuuccacgagcucgugaugaaggacggccgggugcuggucgugcccugccgcaaccaggacgagcugaucggccgggcccgcaucucccagggggcgggcuggagccucaaggagaccgccugccuggggaaguccuacgcccagauguggacccugauguacuuccaccggcgcgaccuccggcuggccgccaacgcgaucugcagcgccgugcccucccacuggguccccaccagccgcacgaccugguccauccacgccaagcacgaguggaugaccaccgaggacaugcuggccguguggaaccggguguggauccaggagaacccguggauggaggacaagacgcccgucgagagcugggaggaggugcccuaccucggcaagcgcgaggaccaguggugcgggucccugaucggccugaccagccgggcgaccugggccaagaacauccagaccgccaucaaccaggugcgcagccucaucggcaacgaggaguacacggacuacaugcccuccaugaagcgcuuccggcgcgaggaggaggaggccgggguccugugguga

SEQ ID NO: 9470 - RNA, 9876 nt, Artificial Sequence
  derived and/or modified CDS sequence (opt1) from DENV-2__EU482605__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccugcucgucaccggccaccugaagugccgccugcggauggacaagcuccagcugaaggggauguccuacagcaugugcaccggcaaguucaagaucgugaaggagaucgccgagacccagcacgggacgaucgugauccgcauccaguacgagggcgacggcucccccugcaagauccccuucgagaucaccgaccuggagaagcggcacguccucgggcgccugaucaccgugaacccgaucgugaucgagaaggacagccccgucaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccaggucuucggggcgaucuacggcgccgccuucagcgggguguccuggaccaugaagauccugaucggcguggucaucacguggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgacuucugcgaggggaccaccgugguggucacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcgugggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugauggugcugaagaucgugcgcaacauggagaaguaccagcucgccgucaccaucauggccaucuccugcgugccgaacgccgugauccugcggaacgccuggaaggucagcugcaccauccuggcggccguguccgucagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgugggcauggugagcauccucgccuccagccugcugaagaacgacauccccaugaccgggccccucgucgccggcgggcugcugaccgugugcuacgugcucaccggccgcagcgcggaccuggagcuggagcgggccgccgacgucaagugggaggaccaggccgagaucuccgggagcucccccauccucagcaucacgaucuccgaggacggcagcauguccaucaagaacgaggaggaggagcagacccugaccauccugauccgcaccggccuccuggugaucagcgggguguucccggucuccauccccaucaccgccgcggccugguaccugugggaggugaagaagcagcgggccggcgugcucugggacguccccagcccgccgcccguggggaaggccgagcuggaggacggcgccuaccgcaucaagcagcgggggauccugggcuacucccagaucggcgcggggguguacaaggagggcacguuccacaccauguggcacgucacccgcggggccgugcucaugcaccggggcaagcgcaucgagcccagcugggccgacgugaagaaggaccugaucuccuacgggggcggcuggaagcuggagggggaguggaaggagggcgaggagguccaggugcucgcccuggagcccgggaagaacccccgggccgugcagaccaagcccggcaucuucaagacgaacaccgggaccaucggcgcggucagccuggacuucucccccggcaccagcgggucccccaucguggaccgcaagggcaagguggucgggcucuacggcaacggcguggugacgcggagcggggccuacgucuccgccaucgcccagaccgagaaguccaucgaggcgaaccccgagaucgaggacgccaucuuccgcaagaagcggcugaccaucauggaccugcaccccggcgccgggaagcccaagcgcagccucccggccaucgugcgggaggccaucaagcgcggccugcgcccccugauccuggcgccgccccggguggucccggccgagauggaggagccccuccgcgggcugcccauccgguaccagacccccgccaucaagccggaccacacgggccgcgagaucguggcccugaugugccacgcccccuucaccaugcggcuccugucccccgugcgcguccccaacuacaaccugaucaucauggacgaggcgcacuucaccgacccggccagcaucgccgcccggggcuacaucuccacccgcguggagaugggggaggccgcgggcaucuucaugacggccacgccgcccgggagccgggaccccuucccgcaguccaacgcccccaucauggacgaggagcgcgagauccccgagcggagcuggaacuccggccacgagugggugaccgacuucaaggggaagaccgucugguucgugcccagcaucaaggccggcaacgacaucgcggccugccuccgcaagaacggcaagaaggugauccagcugucccggaagacguucgacagcgaguacgucaagacccgcgccaacgacugggacuucguggugaccaccgacaucuccgagaugggggccaacuucaaggccgagcgggucaucgacccgcgccggugcaugaagcccgugauccugacggacggcgaggagcgcgugauccucgcggggcccaugccggucacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagaagguggacgcgaucgacggggaguaccggcugcgcggcgaggcccggaagaccuucguggaccugaugcgccgcggggaccuccccgucuggcuggccuacaagguggccgccgagggcaucaacuacgcggaccgcaaguggugcuucgacgggaucaagaacaaccagauccuggaggagaacguggaggucgagaucuggacgaaggagggcgagcggaagaagcucaagccccgcuggcuggacgcccggaucuacuccgacccgcuggcccucaaggaguucaaggaguucgccgcgggccgcaagagccugacccugaaccucaucaccgagauggggcggcugcccaccuucaugacgcagaaggcccgcaacgcccuggacaaccucgccgugcugcacaccgccgaggcgggcgggcgggccuacaaccacgcccuguccgagcuccccgagacccuggagacccugcuccugcugacgcuccuggccaccgucaccggcggcaucuuccuguuccucaugagcgggaagggcaucgggaagaugacccugggcaugugcugcaucaucacggccuccgugcugcucugguacgcgcagauccagccccacuggaucgccgccagcaucauccuggaguucuuccugaucgugcuccugaucccggagcccgagaagcagcgcacgccccaggacaaccagcugaccuacgucgugaucgccauccucaccguggucgccgcgaccauggccaacgagaugggguuccuggagaagacgaagaaggaccugggccucggcagcaucaccacccaggaguccgagagcaacauccuggacaucgaccugcggcccgccuccgccuggacccucuacgccguggcgacgaccuucgugaccccgaugcugcgccacagcaucgagaacuccagcgucaacgugucccugaccgccaucgccaaccaggccacggugcucauggggcugggcaagggguggccccugagcaagauggacaucggcgucccccuccuggcgaucgggugcuacucccaggugaaccccaucacccugaccgccgcccuccugcugcucguggcccacuacgccaucaucggcccgggccugcaggcgaaggccacccgggaggcccagaagcgcgccgccgcggggaucaugaagaaccccacggucgacggcaucaccgugaucgaccuggagcccauccccuacgacccgaaguucgagaagcagcucggccaggugaugcugcugauccucugcgucacccaggugcugaugaugcggaccacgugggcccugugcgaggcccucacccuggccaccggccccaucagcacccugugggaggggaaccccggccgcuucuggaacacgaccaucgccguguccauggcgaacaucuuccgcggcagcuaccucgccggggccggccugcuguucuccaucaugaagaacaccaccaacacgcggcgcgggaccggcaacaucggcgagacccucggggagaaguggaagucccggcugaacgcccugggcaaguccgaguuccagaucuacaagaaguccgggauccaggaggucgaccgcacccucgcgaaggagggcaucaagcgcggggagacggaccaccacgccgugucccgcggcagcgccaagcugcggugguucguggagcgcaacauggucacccccgagggcaaggugguggaccuggggugcggccgcggcgggugguccuacuacugcggcgggcucaagaacguccgcgaggugaaggggcugaccaagggcgggccggggcacgaggagcccauccccaugagcaccuacggcuggaaccuggugcggcuccagagcggggucgacguguucuucacgccgcccgagaagugcgacacccugcugugcgacaucggcgaguccagccccaaccccaccaucgaggccggccgcacccuccgggugcugaaccuggucgagaacuggcucaacaacaacacgcaguucugcaucaaggugcugaacccguacaugcccuccgugaucgagaagauggagacccugcagcgcaaguacgggggcgcccucguccggaacccccugagccgcaacuccacccacgagauguacugggugagcaacgcgaccgggaacaucguguccagcgucaacaugaucucccggaugcugaucaaccgcuucaccaugaagcacaagaaggccacguacgagcccgacguggaccugggcagcgggacccggaacaucggcaucgaguccgagaucccgaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggucgugcgccugcugaccaagcccugggacgugguccccauggugacccagauggccaugacggacaccaccccguucggccagcagcggguguucaaggagaaggucgacacccgcacgcaggagcccaaggagggcaccaagcggcucaugcgcaucaccgcggaguggcuguggaaggagcuggggaagaagaagacgccccggaugugcacgcgcgaggaguucacccggaaggugcgcuccaacgccgcccucggcgccaucuucaccgacgagaacaaguggaaguccgcccgggaggcgguggaggacgggcgcuucugggagcuggucgacaaggagcggaaccugcaccucgagggcaagugcgagaccugcguguacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacagccucuccggggucgagggcgagggccugcaccgccugggguacauccuccgggacgugggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggucgugcgggugcagcgccccaccccgcggggcaccgucauggacaucaucagccgccgcgaccagcggggguccggccagguggggaccuacggccugaacacguucaccaacauggaggcccagcucauccgccagauggagggcgaggggaucuucaagagcauccagcaccugaccgccaccgaggagaucgccgugcagaacuggcuggcccgggucggccgcgagcggcucucccgcauggcgaucagcggggacgacugcguggugaagcccaucgacgaccgguucgccuccgcccugacggcccugaacgacaugggcaagguccgcaaggacauccagcagugggagcccagccggggguggaacgacuggacccaggugcccuucugcucccaccacuuccacgagcucgugaugaaggacggccgcguccugguggugccgugccggaaccaggacgagcugaucggccgcgcccggaucagccagggggcgggcuggucccucaaggagaccgccugccugggcaagagcuacgcccagauguggacccugauguacuuccaccgccgggaccuccgccuggccgccaacgcgaucugcuccgccguccccagccacugggugcccacgucccggaccaccuggagcauccacgccaagcacgaguggaugaccaccgaggacaugcuggccguguggaaccgcgucuggauccaggagaaccccuggauggaggacaagacgccgguggaguccugggaggaggugcccuaccucggcaagcgggaggaccaguggugcgggagccugaucggccugaccagccgcgcgaccugggccaagaacauccagaccgccaucaaccagguccgcucccucaucggcaacgaggaguacacggacuacaugcccagcaugaagcgguuccgccgggaggaggaggaggccggggugcugugguga

SEQ ID NO: 9471 - RNA, 9876 nt, Artificial Sequence
  derived and/or modified CDS sequence (opt1) from DENV-2__EU482606__SS-prME
accgccggcgugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccaccccacguucaccaugcggcuccugagcccggugcgcgugcccaacuacaaccugaucaucauggacgaggcccacuucaccgaccccgcguccaucgccgcccggggcuacaucagcacccgcgucgagaugggggaggccgccggcaucuucaugacggcgacgccgcccgggucccgggaccccuucccccagagcaacgcccccaucauggacgaggagcgcgagauccccgagcgguccuggaacagcggccacgagugggugaccgacuucaaggggaagaccgugugguucguccccuccaucaaggccggcaacgacaucgccgcgugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgccgggccgaugcccgugacccacuccagcgcggcccagcggcgcggccgcaucgggcggaaccccaagaacgagaacgaccaguacaucuacaugggcgagccccuggagaacgacgaggacugcgcccacuggaaggaggccaagaugcugcucgacaacaucaacaccccggagggcaucauccccuccauguucgagcccgagcgcgagaaggucgacgccaucgacggggaguaccggcugcgcggcgaggcgcggaagaccuucguggaccugaugcgccgcggggaccucccgguguggcuggccuacaaggucgccgccgagggcaucaacuacgccgaccgcaaguggugcuucgacgggaucaagaacaaccagauccuggaggagaacguggagguggagaucuggacgaaggagggcgagcggaagaagcucaagccccgcuggcuggacgcgcggaucuacagcgacccccuggcccucaaggaguucaaggaguucgccgccggccgcaagucccugacccugaaccucaucaccgagauggggcggcugcccaccuucaugacgcagaaggcgcgcaacgcccuggacaaccucgccguccugcacaccgccgaggccggcgggcgggcguacaaccacgcccugagcgagcucccggagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcccagauccagccccacuggaucgcggccuccaucauccuggaguucuuccugaucgugcuccugauccccgagcccgagaagcagcgcacgccgcaggacaaccagcugaccuacguggucaucgccauccucaccgugguggccgccaccauggcgaacgagaugggguuccuggagaagacgaagaaggaccugggccucggcagcaucaccacccaggagagcgaguccaacauccuggacaucgaccugcggcccgccagcgccuggacccucuacgccgucgccacgaccuucgugacccccaugcugcgccacuccaucgagaacagcuccgugaacgucagccugaccgcgaucgccaaccaggccacggugcucauggggcugggcaagggguggccccuguccaagauggacaucggcgugccgcuccuggccaucgggugcuacagccaggucaaccccaucacccugaccgcggcccuccugcugcucguggcccacuacgccaucaucggccccggccugcaggccaaggcgacccgggaggcccagaagcgcgccgccgccgggaucaugaagaaccccacgguggacggcaucaccgucaucgaccuggagccgauccccuacgaccccaaguucgagaagcagcucggccaggugaugcugcugauccucugcgugacccagguccugaugaugcggaccacgugggcgcugugcgaggcccucacccuggccaccggccccaucuccacccugugggaggggaacccgggccgcuucuggaacacgaccaucgccgugagcauggccaacaucuuccgcggcuccuaccucgcgggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgccaaggagggcaucaagcgcggggagacggaccaccacgcggucagccgcggcuccgccaagcugcggugguucguggagcgcaacauggugacccccgagggcaaggucguggaccuggggugcggccgcggcggguggagcuacuacugcggcgggcucaagaacgugcgcgaggucaaggggcugaccaagggcggccccgggcacgaggagcccaucccgauguccaccuacggcuggaaccuggugcggcuccagagcgggguggacgucuucuucacgccgcccgagaagugcgacacccugcugugcgacaucggcgagagcucccccaacccgaccaucgaggccggccgcacccuccgggugcugaaccugguggagaacuggcucaacaacaacacccaguucugcaucaagguccugaaccccuacaugcccagcgugaucgagaagauggagacgcugcagcgcaaguacgggggcgcccucgugcggaacccgcugucccgcaacagcacccacgagauguacugggucuccaacgccaccgggaacaucgugagcuccgugaacaugaucagccggaugcugaucaaccgcuucaccaugaagcacaagaaggcgacguacgagcccgacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagccgugggacguggugcccauggucacccagauggccaugacggacaccacccccuucggccagcagcggguguucaaggagaagguggacacccgcacgcaggagcccaaggagggcaccaagaagcucaugcggaucaccgccgaguggcuguggaaggagcuggggaagaagaagaccccgcgcaugugcacgcgggaggaguucacccgcaagguccggagcaacgcggcccucggcgccaucuucaccgacgagaacaaguggaaguccgcccgcgaggccguggaggacgggcgguucugggagcugguggacaaggagcgcaaccugcaccucgagggcaagugcgagaccugcgucuacaacaugauggggaagcgggagaagaagcugggcgaguucggcaaggcgaaggggagccgcgccaucugguacauguggcugggcgcccgguuccucgaguucgaggcccugggguuccugaacgaggaccacugguucucccgcggcaacagccucagcgggguggagggcgagggccugcaccggcugggguacauccuccgcgacgucggcaagaaggagggcggcgcgauguacgccgacgacacggccgggugggacacccggaucacccuggaggaccugaagaacgaggagauggugaccaaccacaugaagggcgagcacaagaagcucgccgaggccaucuucaagcugacguaccagaacaaggugguccgcgugcagcggcccacgccccggggcaccgugauggacaucaucucccggcgcgaccagcgcgggagcggccaggucgggaccuacggccugaacacguucaccaacauggaggcgcagcucauccggcagauggagggcgaggggaucuucaaguccauccagcaccugaccgccaccgaggagaucgccgugcagaacuggcuggcccgcgugggccgggagcgccucagccggauggccaucuccggggacgacugcgucgugaagcccaucgacgaccgcuucgcgagcgcccugacggcccugaacgacaugggcaaggugcggaaggacauccagcagugggagccgucccgcggguggaacgacuggacccagguccccuucugcagccaccacuuccacgagcucgugaugaaggacggccgggugcuggucgugcccugccgcaaccaggacgagcugaucggccgggcccgcaucucccagggggccggcuggagccucaaggagaccgcgugccuggggaaguccuacgcccagauguggacccugauguacuuccaccggcgcgaccuccggcuggccgccaacgccaucugcagcgcggugcccucccacugggucccgaccagccgcacgaccugguccauccacgccaagcacgaguggaugaccaccgaggacaugcuggccguguggaaccggguguggauccaggagaaccccuggauggaggacaagacgcccgucgagagcugggaggaggugcccuaccucggcaagcgcgaggaccaguggugcgggucccugaucggccugaccagccgggccaccugggcgaagaacauccagaccgccaucaaccaggugcgcagccucaucggcaacgaggaguacacggacuacaugccguccaugaagcgcuuccggcgcgaggaggaggaggccgggguccugugguga

SEQ ID NO: 9472 - RNA, 9876 nt, Artificial Sequence
  derived and/or modified CDS sequence (opt1) from DENV-2__EU482607__SS-prME
accgcgggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcgucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcggccuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaucgaggccgagcugaccggguacggcaccgucacgauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacccuggucacguucaagaacccccacgcgaagaagcaggacguggucgugcucgggucccaggagggcgccaugcacaccgcccugaccggggccaccgagauccagaugagcagcggcaaccuccucuucacgggccaccugaagugccgccugcggauggacaagcuccagcugaaggggauguccuacagcaugugcaccggcaaguucaagaucgugaaggagaucgccgagacccagcacgggaccaucgucauccgcgugcaguacgagggcgacggcucccccugcaagauccccuucgagaucacggaccuggagaagcggcacgugcucgggcgccugaucaccgucaacccgaucgugaccggcaaggacagccccgugaacaucgaggcggagccgcccuucggggacuccuacaucaucaucggcgucgagccggggcagcugaagcucaacugguucaagaagggcagcuccaucggccagauguucgagaccacgaugcgcggggccaagcggauggccauccugggcgacaccgccugggacuucgggagccugggcgggguguucaccuccaucggcaaggcccuccaccagguguucggcgcgaucuacggggccgccuucagcggcgucuccuggaccaugaagauccugaucggggugaucaucacguggaucggcaugaacagccgcuccaccagccuguccgugagccugguccucguggggguggucacccuguaccugggcgccauggugcaggcggacuccggcugcguggucagcuggaagaacaaggagcucaagugcggguccggcaucuucaucaccgacaacgugcacacguggaccgagcaguacaaguuccagcccgagagccccagcaagcuggccuccgccauccagaaggcccacgaggaggggaucugcggcauccggagcgugacccgccuggagaaccucauguggaagcagaucacccccgagcugaaccacauccuguccgagaacgaggucaagcucacgaucaugaccggggacaucaagggcaucaugcaggccggcaagcggagccugcgcccgcagcccaccgagcugaaguacuccuggaagaccugggggaaggcgaagaugcucagcacggagucccacaaccagaccuuccugaucgacggccccgagaccgccgagugcccgaacaccaaccgggccuggaacagccuggagguggaggacuacggguucggcguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacgggguccuggagagcgagaugaucauccccaagaacuucgccggccccgugucccagcacaacuaccgcccgggguaccacacccagacggcgggccccuggcaccucgggaagcuggagauggacuucgacuucugcgagggcaccaccguggucgugaccgaggacugcggcaaccgggggcccagccugcgcacgaccaccgccagcggcaagcucaucaccgaguggugcugccgguccugcacgcugcccccgcugcgcuaccgcggggaggacggcugcugguacgggauggagauccgcccccucaaggagaaggaggagaaccuggugaacagccuggucaccgccggccacggccagaucgacaacuucucccucggggugcugggcauggcccuguuccucgaggagaugcugcggacccgcguggggaccaagcacgcgauccugcucgucgccgugagcuucgugacgcugaucaccggcaacauguccuuccgggaccuggggcgcgucauggugauggugggcgccaccaugaccgacgacaucggcaugggggucacguaccucgcccugcuggccgcguucaaggugcgccccaccuucgccgccggccuccugcugcggaagcucaccagcaaggagcugaugauggccaccaucgggaucgcccugcucucccagagcacgauccccgagaccauccuggagcugaccgacgcgcucgcccugggcaugauggugcugaagaucguccgcaacauggagaaguaccagcucgccgugaccgugauggccaucuccugcgucccgaacgccgugauccugcagaacgcguggaaggucagcugcacgauccuggccgccguguccgugagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgucgggauggugagcauccucgccuccagccugcugaagaacgacauccccaugaccggcccccucguggccggcgggcugcugacggucugcuacgugcucaccgggcggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacccugacgauccugauccggaccgggcuccuggucaucagcggcguguucccgguguccauccccaucaccgcggccgccugguaccugugggaggucaagaagcagcgcgccggggugcucugggacgugcccagcccgccgcccgucggcaaggccgagcuggaggacggggcguaccggaucaagcagcgcggcauccugggcuacucccagaucggggccggcguguacaaggaggggaccuuccacaccauguggcacgugacgcggggcgccguccucaugcaccgcgggaagcggaucgagcccagcugggccgacgugaagaaggaccugaucuccuacggcggcggguggaagcuggagggcgaguggaaggagggggaggaggugcagguccucgcccuggagcccggcaagaacccccgcgcggugcagaccaagcccgggaucuucaagaccgacaccggcacgaucggcgccgugagccuggacuucucccccgggaccagcggcucccccaucgucgaccggaaggggaagguggugggccucuacggcaacggggucgugacccgcagcggcgccuacguguccgccaucgcgcagaccgagaaguccaucgaggacaaccccgagaucgaggacgacaucuuccggaagaagcgccugacgaucauggaccugcaccccggggccggcaagaccaagcgguaccuccccgccaucguccgcgaggccaucaagcgggggcugcgcacccugauccuggccccgacccgcgugguggcggccgagauggaggaggcccuccggggccugcccauccgcuaccagacgcccgccaucaaggccgagcacaccggccgggagaucgucgaccugaugugccacgcgaccuucaccaugcgccuccugagccccgugcgggugccgaacuacaaccugaucaucauggacgaggcccacuucacggaccccgccuccaucgccgcccgcggguacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugacggacuucaagggcaagaccgugugguucgucccguccaucaaggcgggcaacgacaucgccgccugccuccggaagaacgggaagaaggugauccagcugagccgcaagaccuucgacuccgaguacgugaagacccgggccaacgacugggacuucgucgugacgaccgacaucagcgagaugggcgccaacuucaaggcggagcgcgugaucgacccccggcgcugcaugaagcccgucauccugaccgacggggaggagcgggugauccucgccggccccaugccggugacccacuccagcgccgcccagcgccgggggcgcaucggccgcaaccccaagaacgagaacgaccaguacaucuacaugggcgagccccuggagaacgacgaggacugcgcccacuggaaggaggcgaagaugcugcucgacaacaucaacacgcccgaggggaucaucccguccauguucgagcccgagcgggagaaggucgacgccaucgacggcgaguaccgccugcgcggggaggcccgcaagaccuucguggaccugaugcggcgcggcgaccuccccguguggcuggccuacaaggucgccgcggaggggaucaacuacgccgaccggaaguggugcuucgacggcaucaagaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgcggccgggcggaagucccuggcccugaaccucaucaccgagaugggccgccugcccacguucaugacccagaaggcccggaacgcccuggacaaccucgcggugcugcacaccgccgaggccgggggccgcgccuacaaccacgcccugagcgagcuccccgagacccuggagacgcugcuccugcugacccuccuggcgaccgugaccggcgggaucuuccuguuccucauguccggcaaggggaucggcaagaugacgcuggggaugugcugcaucaucaccgccagcguccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucaccgugguggccgccacgauggccaacgagaugggcuuccuggagaagaccaagaaggaccugggccucgggagcaucaccacccaggagagcgaguccaacauccuggacaucgaccugcgcccggccagcgcguggacgcucuacgccgucgccaccaccuucgugacccccaugcugcggcacuccaucgagaacagcuccgugaacgucagccugacggccaucgcgaaccaggccaccgugcucaugggccuggggaagggcuggccccuguccaagauggacaucggggugccccuccuggccaucggcugcuacagccaggucaacccgaucacccugaccgccgcccuccugcugcucguggcgcacuacgccaucaucggccccgggcugcaggccaaggccacgcgcgaggcccagaagcgggcggccgccggcaucaugaagaaccccaccguggacgggaucaccgucaucgaccuggagcccaucccguacgaccccaaguucgagaagcagcucggccaggugaugcugcugauccucugcgugacccagguccugaugaugcgcacgaccugggcccugugcgaggcccucacccuggcgaccgggcccaucuccacgcugugggagggcaaccccggccgguucuggaacaccaccaucgccgugagcauggccaacaucuuccgcggguccuaccucgccggcgcggggcugcuguucagcaucaugaagaacaccacgaacacccgccggggcaccggcaacaucggggagacccucggcgagaaguggaagucccgccugaacgcccugggcaagagcgaguuccagaucuacaagaaguccggcauccaggagguggaccggacgcucgccaaggaggggaucaagcgcggcgagaccgaccaccacgccgucagccggggcuccgccaagcugcgcugguucguggagcggaacauggugaccccggaggggaaggucguggaccugggcugcgggcgcggcggguggagcuacuacugcggcggccucaagaacgugcgggaggucaaggggcugaccaagggcgggcccggccacgaggagcccauccccauguccacguacggguggaaccuggugcgccuccagagcggcguggacgucuucuucaccccgcccgagaagugcgacacccugcugugcgacaucggcgagagcucccccaaccccaccaucgaggcggggcggacgcuccgcgugcugaaccugguggagaacuggcucaacaacaacacccaguucugcaucaagguccugaacccguacaugcccagcgugaucgagaagauggagacccugcagcggaaguacggcggggcccucgugcgcaacccccugucccggaacagcacccacgagauguacugggucuccaacgccaccggcaacaucgugagcuccgugaacaugaucagccgcaugcugaucaaccgguucacgaugaagcacaagaaggccaccuacgagccggacgucgaccugggguccggcacccgcaacaucggcaucgagagcgagauccccaaccucgacaucaucgggaagcggaucgagaagaucaagcaggagcacgagaccuccuggcacuacgaccaggaccaccccuacaagacgugggccuaccacggcagcuacgagaccaagcagaccggguccgcgagcuccauggugaacggcgugguccgccugcugaccaagcccugggacguggugccgauggucacgcagauggccaugaccgacaccacccccuucggccagcagcgcguguucaaggagaagguggacacgcggacccaggagcccaaggaggggaccaagaagcucaugaagaucaccgccgaguggcuguggaaggagcugggcaagaagaagacgccccgcaugugcacccgggaggaguucacccgcaagguccggagcaacgccgcccucggggcgaucuucaccgacgagaacaaguggaaguccgcccgcgaggccguggaggacggccgguucugggagcuggucgaccgcgagcggaaccugcaccucgaggggaagugcgagacgugcguguacaacaugaugggcaagcgcgagaagaagcugggcgaguucgggaaggccaagggcagccgggcgaucugguacauguggcugggggcccgcuuccucgaguucgaggcccugggcuuccugaacgaggaccacugguucucccgggggaacagccucagcggcguggagggcgaggggcugcaccgccugggcuacauccuccgggacgucgggaagaaggagggcggggccauguacgccgacgacaccgcgggcugggacacccgcaucacccuggaggaccugaagaacgaggagauggugacgaaccacaugaagggcgagcacaagaagcucgccgaggccaucuucaagcugaccuaccagaacaaggugguccgggugcagcgcccgacgccccgggggaccgugauggacaucaucucccgcaaggaccagcggggcagcgggcaggucggcacguacggccugaacaccuucaccaacauggaggcccagcucauccgccagauggagggggagggcaucuucaaguccauccagcaccugaccgccacggaggagaucgcggugcagaacuggcugacccgcguggggcgggagcgccucagccggauggccaucuccggcgacgacugcgucgugaagcccaucgacgaccgcuucgccagcgcccugaccgcccugaacgacauggggaaggugcggaaggacauccagcagugggagcccucccgcggcuggaacgacuggacccaggucccguucugcagccaccacuuccacgagcucgugaugaaggacggccgggugcuggucgugcccugccgcaaccaggacgagcugaucgggcgggcgcgcaucucccagggcgccggguggagccucaaggagacggccugccugggcaaguccuacgcccagauguggacccugauguacuuccaccggcgcgaccuccggcuggccgcgaacgccaucugcagcgccgugcccucccacuggguccccaccagccgcaccaccugguccauccacgccaagcacgaguggaugacgaccgaggacaugcuggcgguguggaaccggguguggauccaggagaacccguggauggaggacaagacccccgucgagagcugggaggaggugcccuaccucgggaagcgcgaggaccaguggugcggcucccugaucggccugaccagccgggccacgugggccaagaacauccagaccgccaucaaccaggugcgcagccucaucgggaacgaggaguacaccgacuacaugcccuccaugaagcgguuccgccgcgaggaggaggaggccggcguccugugguga

SEQ ID NO: 9473 - RNA, 9876 nt, Artificial Sequence
  derived and/or modified CDS sequence (opt1) from DENV-2__EU482608__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcgcacgccccaggacaaccagcugaccuacguggucaucgccauccucaccgugguggccgcgaccauggccaacgagaugggguuccuggagaagacgaagaaggaccugggccucggcagcaucaccacccaggagagcgaguccaacauccuggacaucgaccugcggccggccagcgccuggacccucuacgccgucgcgacgaccuucgugacccccaugcugcgccacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccgcccuccugcugcucguggcccacuacgccaucaucggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucuccacccugugggaggggaaccccggccgcuucuggaacacgaccaucgccgugagcauggcgaacaucuuccgcggcuccuaccucgccggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagacggaccaccacgccgucagccgcggcuccgccaagcugcggugguucguggagcgcaacauggugaccccggagggcaaggucguggaccuggggugcggccgcggcggguggagcuacuacugcggcgggcucaagaacgugcgcgaggucaaggggcugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagcggcucaugcgcaucaccgcggaguggcuguggaaggagcuggggaagaagaagacgccccggaugugcacgcgcgaggaguucacccggaagguccgcagcaacgccgcccucggcgccaucuucaccgacgagaacaaguggaaguccgcccgggaggcgguggaggacgggcgcuucugggagcugguggacaaggagcggaaccugcaccucgagggcaagugcgagaccugcgucuacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccggggcaacagccucagcgggguggagggcgagggccugcaccgccugggguacauccuccgggacgucggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaucaaggugguccgggugcagcgcccgacgccccggggcaccgugauggacaucaucucccgccgcgaccagcgggggagcggccaggucgggaccuacggccugaacacguucaccaacauggaggcccagcucauccgccagauggagggcgaggggaucuucaaguccauccagcaccugaccgccaccgaggagaucgccgugcagaacuggcuggcccgggugggccgcgagcggcucagccgcauggcgaucuccggggacgacugcgucgugaagcccaucgacgaccgguucgccagcgcccugacggcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucggccgcgcccggaucucccagggggcgggcuggagccucaaggagaccgccugccuggggaaguccuacgcccagauguggacccugauguacuuccaccgccgggaccuccgccuggccgccaacgcgaucugcagcgccgugcccucccacuggguccccaccagccggacgaccugguccauccacgccaagcacgaguggaugaccaccgaggacaugcuggccguguggaaccgcguguggauccaggagaacccguggauggaggacaagacgcccgucgagagcugggaggaggugcccuaccucggcaagcgggaggaccaguggugcgggucccugaucggccugaccagccgcgcgaccugggccaagaacauccagaccgccaucaaccaggugcgcagccucaucggcaacgaggaguacacggacuacaugcccuccaugaagcgguuccgccgggaggaggaggaggccgggguccugugguga

SEQ ID NO: 9474 - RNA, 9876 nt, Artificial Sequence
  derived and/or modified CDS sequence (opt1) from DENV-2__EU687220__SS-prME
accgcgggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucgccaucauggcggccauccuggccuacaccaucgggaccacccacuuccagaaggcccucaucuucauccugcugaccgcgguggcccccagcaugaccaugcggugcaucggcaucuccaaccgcgacuucguggagggcgucagcgggggcuccuggguggacaucgugcucgagcacgggagcugcgucaccaccauggccaagaacaagcccacccuggacuucgagcugaucaagaccgaggccaagcagcccgccacccuccggaaguacugcaucgaggcgaagcugaccaacacgaccaccgagucccgcugcccgacccagggcgagcccagccugaacgaggagcaggacaagcgguucaucugcaagcacuccaugguggaccgcggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccgccagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccggcuccgcauggacaagcugcagcugaaggggauguccuacagcaugugcaccggcaaguucaagaucgucaaggagaucgcggagacccagcacgggaccaucgugauccgggugcaguacgagggcgacggcucccccugcaagauccccuucgagaucauggaccucgagaagcgccacguccuggggcggcugaucacggugaacccgaucgugaccgagaaggacagccccaucaacaucgaggccgagccgcccuucggcgacuccuacaucaucaucggggucgagccgggccagcucaagcugaacugguucaagaaggggagcuccaucggccagauguucgagaccaccaugcgcggcgccaagcgcauggccauccugggggacacggccugggacuucggcagccucgggggcguguucaccuccaucgggaaggcgcugcaccagguguucggcgccaucuacggcgccgccuucagcggggucuccuggaccaugaagauccugaucggcgugaucaucaccuggaucgggaugaacagccgguccacgagccuguccgugagccucguccuggugggcguggucacccuguaccucggggcgauggugcaggccgacuccggcugcguggucagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccgcagcgugacccggcucgagaaccugauguggaagcagaucacccccgagcugaaccacauccucuccgagaacgaggucaagcugaccaucaugacgggcgacaucaaggggaucaugcaggcgggcaagcgcagccugcggccgcagcccaccgagcucaaguacuccuggaagaccuggggcaaggccaagaugcugagcaccgagucccacaaccagacguuccugaucgacgggcccgagaccgccgagugcccgaacaccaaccgcgccuggaacagccucgagguggaggacuacggcuucgggguguucuccaccaacaucuggcugaagcugcgggagaagcaggacgucuucugcgacagcaagcucauguccgccgcgaucaaggacaaccgcgccgugcacgccgacaugggcuacuggaucgagagcgcccugaacgacacguggaagauggagaaggccuccuucaucgaggucaagagcugccacuggcccaagucccacacccuguggagcaacggcgugcucgaguccgagaugaucauccccaagaacuucgcggggcccgugagccagcacaacuaccggccgggcuaccacacccagaccgccgggcccuggcaccugggcaagcuggagauggacuucgacuucugcgaggggaccacgguggucgugaccgaggacugcggcaaccgcggccccagccuccggaccaccacggccuccgggaagcugaucaccgaguggugcugccgcagcugcacccugcccccgcuccgguaccgcggcgaggacgggugcugguacggcauggagauccggccccugaaggagaaggaggagaaccuggugaacucccucgucaccgccgggcacggccagaucgacaacuucagccugggcgugcuggggauggcccucuuccuggaggagaugcugcgcacgcgggugggcaccaagcacgccauccuccuggucgccguguccuucgugacccugaucaccgggaacaugagcuuccgcgaccucggccgggucauggugauggugggggccacgaugaccgacgacaucggcaugggcgucaccuaccuggcccugcucgcggccuucaaggugcgccccaccuucgccgccgggcugcugcuccgcaagcugacguccaaggagcugaugauggccaccaucggcaucgcgcuccugagccaguccaccauccccgagaccauccuggagcucacggacgcccuggcccuggggaugauggugcucaagaucguccggaacauggagaaguaccagcuggccgugaccaucauggccaucagcugcgugccgaacgcggucauccugcucaacgccuggaagguguccugcaccauccuggccgccgugagcgucagcccccugcuccugaccagcucccagcagaaggcggacuggaucccccuggcccucacgaucaagggccugaaccccaccgccaucuuccugaccacccucagccgcacguccaagaagcggagcuggccgcugaacgaggccgugauggccgucggcaugguguccauccuggcgagcagccuccugaagaacgacauccccaugaccgggccccugguggccggcgggcuccugaccgucugcuacgugcugaccggccgcuccgccgaccucgagcuggagcgggccgccgacgugaagugggaggaccacgcggagaucagcggguccagccccauccuguccaucacgaucagcgaggacggcuccaugagcaucaagaacgaggaggaggagcagacccucaccauccugauccgcaccggccugcucgucaucuccgggguguucccggugagcauccccaucacggccgccgccugguaccugugggaggucaagaagcagcgggccggcgugcugugggacgugcccagcccgccgcccgucgggaaggcggagcucgaggacggcgccuaccgcaucaagcagcgggggauccugggcuacagccagaucggcgccgggguguacaaggagggcaccuuccacaccauguggcacgugacccgcggggccguccugaugcaccggggcaagcgcaucgagcccuccugggccgacgugaagaaggaccucaucagcuacgggggcggcuggaagcuggagggggaguggaaggagggcgaggaggugcagguccuggcgcucgagcccgggaagaacccccgggccgugcagaccaagcccggccuguucaagacgaacaccgggaccaucggcgccgugucccuggacuucagccccggcaccuccgggagccccaucgucgaccgcaagggcaaggugguggggcucuacggcaacggcgucgugacgcgguccggggccuacgugagcgcgaucgcccagaccgagaaguccaucgaggacaaccccgagaucgaggacgacaucuuccgcaagaagcggcugaccaucauggaccugcaccccggcgccgggaagaccaagcgcuaccugcccgccaucguccgggaggccaucaagcgcggccuccggacgcugauccuggcgccgacccgcgugguggccgccgagauggaggaggcccuccgcgggcugcccauccgguaccagacccccgccauccgcgcggagcacaccggccgggagaucgucgaccugaugugccacgccacguucaccaugcgccuccugucccccgugcgggugccgaacuacaaccugaucaucauggacgaggcccacuucaccgaccccgccagcaucgccgcgcgcggcuacaucuccacccgggucgagaugggggaggccgccggcaucuucaugacggccacgccgcccgggagccgcgacccguucccccaguccaacgcgcccaucauggacgaggagcgggagauccccgagcgcagcuggaacuccggccacgagugggugaccgacuucaaggggaagaccgugugguucgucccgagcaucaaggccggcaacgacaucgccgccugccuccggaagaacggcaagaaggugauccagcugucccgcaagacguucgacagcgaguacgugaagacccgggccaacgacugggacuucgucgugaccaccgacaucuccgagaugggggcgaacuuccgcgccgagcgggugaucgacccccgccggugcaugaagcccgucauccugacggacggcgaggagcgcgugauccucgccgggcccaugccggugacccacagcuccgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccgagcauguucgagcccgagcgcgagaaggucgacgccaucgacggggaguaccggcugcgcggcgaggcccggaagaccuucguggaccugaugcgccgcggggaccuccccguguggcuggccuaccgcgucgcggccgagggcaucaacuacgccgaccggcgcuggugcuucgacgggaucaagaacaaccagauccuggaggagaacguggagguggagaucuggacgaaggagggcgagcggaagaagcucaagccgcgcuggcuggacgcccggaucuacuccgacccccuggcgcucaaggaguucaaggaguucgccgccggccgcaagagccugacccugaaccucaucaccgagauggggcggcugcccaccuucaugacgcagaaggcccgcgacgcccuggacaaccucgcgguccugcacaccgccgaggccggcgggcgggccuacaaccacgcccuguccgagcuccccgagacccuggagacccugcuccugcugacgcuccuggcgaccgugaccggcggcaucuuccuguuccucaugagcgggaagggcaucgggaagaugacccugggcaugugcugcaucaucacggccuccauccugcucugguacgcccagauccagccgcacuggaucgccgccagcaucauccuggaguucuuccugaucguccuccugauccccgagcccgagaagcagcgcacgccccaggacaaccagcugaccuacguggugaucgcgauccucaccgucguggccgccaccauggccaacgagaugggguuccuggagaagacgaagaaggaccugggccucggcagcaucaccacccaggaguccgagagcaacauccuggacaucgaccugcggccggccuccgcguggacccucuacgccguggccacgaccuucgucacccccaugcugcgccacagcaucgagaacuccagcgugaacgugucccugaccgccaucgcgaaccaggccacgguccucauggggcugggcaagggguggccccugagcaagauggacaucggcgugccccuccuggccaucgggugcuacucccaggugaacccgaucacccugaccgccgcccuccugcugcucgucgcgcacuacgccaucaucggccccggccugcaggccaaggccacccgggaggcccagaagcgcgcggccgccgggaucaugaagaaccccacgguggacggcaucaccgugaucgaccuggagcccaucccguacgaccccaaguucgagaagcagcucgggcaggucaugcugcugauccucugcgugacccaggugcugaugaugcgcaccacgugggcccugugcgaggcccucacccuggcgaccggccccaucagcacccugugggaggggaaccccggccgguucuggaacacgaccaucgccgucuccauggccaacaucuuccgcggcagcuaccucgccggggcgggccugcuguucuccaucaugaagaacaccaccaacacgcggcgcgggaccggcaacaucggcgagacccucggggagaaguggaagucccggcugaacgcccugggcaaguccgaguuccagaucuacaagaaguccgggauccaggagguggaccgcacccucgccaaggagggcaucaagcgcggggagacggaccaccacgccgugucccgcggcagcgccaagcugcggugguucgucgagcgcaacauggugaccccggagggcaagguggucgaccuggggugcggccgcggcgggugguccuacuacugcggcgggcucaagaacgugcgcgaggugaaggggcugaccaagggcgggcccgggcacgaggagcccauccccaugagcaccuacggcuggaaccugguccggcuccagagcgggguggacguguucuucacgccgcccgagaagugcgacacccugcugugcgacaucggcgaguccagccccaaccccaccaucgaggcgggccgcacccuccggguccugaaccugguggagaacuggcucaacaacaacacgcaguucugcaucaaggugcugaacccguacaugcccuccgucaucgagaagauggagacccugcagcgcaaguacgggggcgcccuggugcggaacccccucagccgcaacuccacccacgagauguacugggugagcaacgccaccgggaacaucgucuccagcgugaacaugaucucccggaugcugaucaaccgcuucaccaugaagcacaagaaggccacguacgagccggacguggaccugggcagcgggacccgcaacaucggcaucgaguccgagauccccaaccucgacaucaucggcaagcggaucgagaagaucaagcaggagcacgagaccagcuggcacuacgaccaggaccaccccuacaagaccugggccuaccacggguccuacgagacgaagcagaccggcagcgcguccagcauggucaacgggguggugcgccugcugaccaagcccugggacgucgugccgauggugacccagauggccaugacggacaccacccccuucggccagcagcgggucuucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaaggugcgguccaacgccgcccucggcgcgaucuucaccgacgagaacaaguggaaguccgcccgcgaggccgucgaggacucccgguucugggagcugguggaccgcgagcggaaccugcaccucgaggggaagugcgagaccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucagccgggggaacucccucagcggcgucgagggggagggccugcaccgccugggcuacauccuccgggacguguccaagaaggagggcggggccauguacgccgacgacacggcggggugggacacccgcaucacccuggaggaccugaagaacgaggagauggucaccaaccacaugaagggcgagcacaagaagcucgccgaggccaucuucaagcugacguaccagaacaagguggugcggguccagcgcccgacgccccgggggaccgugauggacaucaucagccggcgcgaccagcggggcuccggccagguggggaccuacggccugaacacguucaccaacauggaggcccagcucauccgccagauggagggggagggcaucuucaagagcauccagcaccugaccgucaccgaggagaucgccgugcagaacuggcuggugcgggucggccgcgagcggcucucccgcauggcgaucagcggggacgacugcguggugaagccccuggacgaccgguucgccuccgcccugacggcccucaacgacaugggcaagguccgcaaggacauccagcagugggagcccagccggggguggaacgacuggacccaggugccguucugcucccaccacuuccacgagcuggugaugaaggacggccgcguccugguggugcccugccggaaccaggacgagcucaucgggcgcgcccggaucagccagggcgcgggcuggucccugaaggagaccgccugccugggcaagagcuacgcccagauguggacccucauguacuuccaccgccgggaccugcgccuggccgccaacgcgaucugcuccgccguccccagccacugggugcccacgucccggaccaccuggagcauccacgccaagcacgaguggaugaccaccgaggacaugcucgccguguggaaccgcgucuggauccaggagaacccguggauggaggacaagacgcccguggagagcugggaggaggugcccuaccugggcaagcgcgaggaccaguggugcgggucccugaucggccucaccagccgggcgaccugggccaagaacauccagaccgccaucaaccagguccgcucccugaucgggaacgaggaguacacggacuacaugcccagcaugaagcgguuccgccgggaggaggaggaggccggcgugcugugguga

SEQ ID NO: 9475 - RNA, 9876 nt, Artificial Sequence
  derived and/or modified CDS sequence (opt1) from DENV-2__EU726775__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgacuucugcgaggggaccaccgugguggucacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcgugggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacucccagaucggcgccgggguguacaaggagggcaccuuccacacgauguggcacgucacccgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgcggugcagaccaagcccggcaucuuccggaccaacacggggaccaucggcgccaucagccuggacuucucccccggcaccagcgggucccccaucgucgaccgcaagggcaaggugguggggcucuacggcaacggcgucgugacccggagcggggccuacguguccgccaucgcgcagacggagaaguccaucgaggacaaccccgagaucgaggacgacaucuuccgcaagaagcggcugaccaucauggaccugcaccccggcgccgggaagaccaagcgcuaccuccccgccaucguccgggaggccaucaagcgcggccugcgcacccugauccuggccccgacgcgggugguggcggccgagauggaggaggcccuccgcgggcugcccauccgguaccagacccccgccaucaaggccgagcacaccggccgcgagaucgucgaccugaugugccacgcgaccuucacgaugcggcuccugagccccgugcgcgugccgaacuacaaccugaucaucauggacgaggcccacuucaccgaccccgccuccaucgccgcccggggcuacaucagcacccgcgucgagaugggggaggcggccggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggcgggcaacgacaucgccgccugccuccgcaagaacggcaagaaggugauccagcugagccggaagaccuucgacuccgaguacgugaagacgcgcgccaacgacugggacuucgucgugaccaccgacaucagcgagaugggggccaacuucaaggcggagcgggugaucgacccccgccggugcaugaagcccgucauccugaccgacggcgaggagcgcgugauccucgccgggcccaugccggugacgcacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuacaaggucgccgcggagggcaucaacuacgccgaccgcaaguggugcuucgacgggaucaagaacaaccagauccuggaggagaacguggagguggagaucuggaccaaggagggcgagcggaagaagcucaagccgcgcuggcuggacgcccggaucuacagcgacccccuggcccucaaggaguucaaggaguucgcggccggccgcaagucccugacgcugaaccucaucaccgagauggggcggcugcccaccuucaugacccagaaggcccgcaacgcccuggacaaccucgccguccugcacacggcggaggccggcgggcgggccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucguccuccugauccccgagcccgagaagcagcgcacgccccaggacaaccagcugacguacguggugaucgccauccucaccgucguggcggccaccauggccaacgagaugggguuccuggagaagaccaagaaggaccugggccucggcagcaucacgacccaggagagcgaguccaacauccuggacaucgaccugcggccggccagcgccuggacccucuacgcgguggccaccacguucgucacccccaugcugcgccacuccaucgagaacagcuccgugaacgugagccugaccgccaucgccaaccaggcgaccguccucauggggcugggcaagggguggccccuguccaagauggacaucggcgugccccuccuggccaucgggugcuacagccaggugaacccgaucacgcugaccgccgcccuccugcugcucgucgcccacuacgcgaucaucggccccggccugcaggccaaggccacccgggaggcccagaagcgcgccgcggccgggaucaugaagaaccccaccguggacggcaucacggugaucgaccuggagcccaucccguacgaccccaaguucgagaagcagcucgggcaggucaugcugcugauccucugcgugacccaggugcugaugaugcggaccaccugggcccugugcgaggcccucacgcuggccaccggccccaucuccacccugugggaggggaaccccggccgcuucuggaacaccacgaucgcggucagcauggccaacaucuuccgcggcuccuaccucgccggggccggccugcuguucagcaucaugaagaacaccaccaacacccggcgcgggacgggcaacaucggcgagacccucggggagaaguggaagucccggcugaacgcgcugggcaagagcgaguuccagaucuacaagaaguccgggauccaggagguggaccgcacccucgccaaggagggcaucaagcgcggggagaccgaccaccacgccgugagccgcggcuccgccaagcugcggugguucgucgagcgcaacauggugacgccggagggcaagguggucgaccuggggugcggccgcgggggcuggagcuacuacugcgggggccucaagaacgugcgcgaggugaagggccugaccaagggcggccccgggcacgaggagcccauccccauguccaccuacggcuggaaccugguccggcuccagagcgggguggacguguucuucaccccgcccgagaagugcgacacgcugcugugcgacaucggcgagagcucccccaaccccaccaucgaggccggccgcacccuccggguccugaaccugguggagaacuggcucaacaacaacacccaguucugcaucaaggugcugaacccguacaugcccagcgucaucgagaagauggagacccugcagcgcaaguacgggggcgcgcucgugcggaacccccugucccgcaacagcacgcacgagauguacuggguguccaacgccaccgggaacaucgucagcuccgugaacaugaucagccggaugcugaucaaccgcuucaccaugaagcacaagaaggccaccuacgagccggacguggaccugggcuccgggacgcggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagaccaagcagacgggcuccgccagcuccauggucaacgggguggugcgccugcugaccaagcccugggacgucgugccgauggugacccagauggcgaugaccgacacgacccccuucggccagcagcgggucuucaaggagaagguggacacccgcacccaggagcccaaggagggcacgaagaagcucaugaagaucaccgccgaguggcuguggaaggagcuggggaagaagaagacgccccggaugugcacccgcgaggaguucacgcggaaggugcgcagcaacgccgcccucggcgccaucuucaccgacgagaacaaguggaaguccgcgcgggaggccgucgaggacgggcgcuucugggagcugguggaccgggagcgcaaccugcaccucgagggcaagugcgagaccugcguguacaacaugauggggaagcgggagaagaagcugggcgaguucggcaaggccaaggggagccgcgccaucugguacauguggcugggcgcgcgguuccucgaguucgaggcccugggguuccugaacgaggaccacugguucucccgcggcaacagccucagcggggucgagggcgagggccugcaccggcugggguacauccuccgcgacgugggcaagaaggagggcggcgccauguacgccgacgacaccgccgggugggacacgcggaucacccuggaggaccugaagaacgaggagauggucaccaaccacaugaagggcgagcacaagaagcucgcggaggccaucuucaagcugaccuaccagaacaagguggugcgcguccagcggccgacgccccgcggcaccgugauggacaucaucucccggcgcgaccagcgcgggagcggccagguggggaccuacggccugaacaccuucacgaacauggaggcccagcucauccggcagauggagggcgaggggaucuuccgcuccauccagcaccugaccgccaccgaggagaucgccguccagaacuggcuggcgcgggugggccgcgagcggcucagccgcauggccaucuccggggacgacugcguggucaagcccaucgacgaccgguucgccagcgcccugaccgcccugaacgacaugggcaaggugcgcaaggacauccagcagugggagcccucccggggguggaacgacuggacccaggucccguucugcagccaccacuuccacgagcucgucaugaaggacggccgcgugcuggugguccccugccggaaccaggacgagcugaucggccgcgcgcggaucucccagggggccggcuggagccucaaggagaccgccugccuggggaaguccuacgcccagauguggacccugauguacuuccaccgccgggaccuccgccuggccgcgaacgccaucugcagcgccgugcccucccacugggugcccaccagccggaccacgugguccauccacgccaagcacgaguggaugaccaccgaggacaugcuggcggucuggaaccgcguguggauccaggagaacccguggauggaggacaagacccccguggagagcugggaggagguccccuaccucggcaagcgggaggaccaguggugcgggucccugaucggccugacgagccgcgccaccugggccaagaacauccagaccgccaucaaccaggugcgcagccucaucggcaacgaggaguacaccgacuacaugcccuccaugaagcgguuccgccgggaggaggaggaggccggggugcugugguga

SEQ ID NO: 9476 - RNA, 9876 nt, Artificial Sequence
  derived and/or modified CDS sequence (opt1) from DENV-2__FJ639732__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccgugaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggucagcugcaccauccuggcggccguguccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggaggucgagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccgugcugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcgcacgccccaggacaaccagcugaccuacguggucaucgccauccucaccgugguggccgcgaccauggccaacgagaugggguuccuggagaagacgaagaaggaccugggccucggcagcaucaccacccaggagagcgaguccaacauccuggacaucgaccugcggccggccagcgccuggacccucuacgccgucgcgacgaccuucgugacccccaugcugcgccacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccgcccuccugcugcucguggcccacuacgccaucaucggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucgggcaggucaugcugcugauccucugcgugacccagguccugaugaugcggaccacgugggcccugugcgaggcccucacccuggccaccggccccaucuccacccugugggaggggaaccccggccgcuucuggaacacgaccaucgccgugagcauggcgaacaucuuccgcggcuccuaccucgccggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagacggaccaccacgccgucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaagguccggagcaacgccgcccucggcgccaucuucaccgacgagaacaaguggaaguccgcccgcgaggcgguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccggggcaacagccucagcgggguggagggcgagggccugcaccgccugggguacauccuccgggacgucggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggugguccgggugcagcgcccgacgccccggggcaccgugauggacaucaucucccgccgcgaccagcgggggagcggccaggucgggaccuacggccugaacacguucaccaacauggaggcccagcucauccgccagauggagggcgaggggaucuucaaguccauccagcaccugaccgccaccgaggagaucgccgugcagaacuggcuggcccgggugggccgcgagcggcucagccgcauggcgaucuccggggacgacugcgucgugaagcccaucgacgaccgguucgccagcgcccugacggcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucggccgcgcccggaucucccagggggcgggcuggagccucaaggagaccgccugccuggggaaguccuacgcccagauguggacccugauguacuuccaccgccgggaccuccgccuggccgccaacgcgaucugcagcgccgugcccucccacuggguccccaccagccggacgaccugguccauccacgccaagcacgaguggaugaccaccgaggacaugcuggccguguggaaccgcguguggauccaggagaacccguggauggaggacaagacgcccgucgagagcugggaggaggugcccuaccucggcaagcgggaggaccaguggugcgggucccugaucggccugaccagccgcgcgaccugggccaagaacauccagaccgccaucaaccaggugcgcagccucaucggcaacgaggaguacacggacuacaugcccuccaugaagcgguuccgccgggaggaggaggaggccgggguccugugguga

SEQ ID NO: 9477 - RNA, 9876 nt, Artificial Sequence
  derived and/or modified CDS sequence (opt1) from DENV-2__FJ639733__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaucgagaaggacagccccgucaacaucgaggcggagccgcccuucggcgacuccuacaucaucaucgggguggagccgggccagcugaagcucaacugguucaagaaggggagcuccaucggccagauguucgaggccaccaugcgcggcgccaagcggauggccauccugggggacacggccugggacuucggcagccucggcggggcguucaccuccaucgggaaggcccuccaccagguguucggggccaucuacggcgccgcguucagcggggucuccuggaccaugaagauccugaucggcguggugaucaccuggaucgggaugaacagccgcuccacgagccuguccgucagccuggugcucgugggcgucgugacccuguaccugggggccauggugcaggccgacuccggcugcgucgugagcuggaagaacaaggagcucaagugcggcuccgggaucuucaucaccgacaacgugcacaccuggacggagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucaccaucaugacgggcgacaccaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggccgggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgcggggcacggccagaucgacaacuucucccucggcgugcuggggauggcccuguuccucgaggagaugcugcggacccgcgucggcaccaagcacgccauccugcucguggccgugagcuucgucacgcugaucaccgggaacauguccuuccgggaccugggccgcgugauggugauggucggggccaccaugaccgacgacaucggcaugggcgugacguaccucgcgcugcuggccgccuucaaggugcgccccaccuucgccgccgggcuccugcugcggaagcucaccagcaaggagcugaugauggcgaccaucggcaucacgcugcucucccagagcaccauccccgagaccauccuggagcugaccgacgcccucgcccuggggaugaugguccugaagaucgugcgcaagauggagaaguaccagcucgccgugacgaucauggccaucuccugcgucccgaacgcggugauccugcggaacgccuggaaggugagcugcaccauccuggccgccgucuccgugagcccccuccugcugaccuccagccagcagaaggcggacuggaucccccucgcccugaccaucaagggccugaaccccacggccaucuuccucaccacccugucccgcaccagcaagaagcgguccuggccgcugaacgaggccaucauggccgucggcauggugagcauccucgcguccagccugcugaagaacgacauccccaugacggggccccucguggccggcgggcugcugaccgucugcuacgugcucaccggccgcagcgccgaccuggagcuggagcgggccgccgacgugaagugggaggaccaggcggagaucuccgggagcucccccauccucagcaucaccaucuccgaggacggcagcauguccaucaagaacgaggaggaggagcagacgcugaccauccugauccgcaccggccuccuggucaucagcgggguguucccgguguccauccccaucaccgccgccgccugguaccugugggaggucaagaagcagcgggccggcgugcucugggacgugcccagcccgccgcccgucgggaaggcggagcuggaggacggcgccuaccgcaucaagcagcgggggauccugggcuacucccagaucggcgccgggguguacaaggagggcaccuuccacacgauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcgcuggagcccgggaagaacccccgggccgugcagaccaagcccggcaucuucaagaccaacacggggaccaucggcgccgugagccuggacuucucccccggcaccagcgggucccccaucgucgaccgcaagggcaaggugguggggcucuacggcaacggcgucgugacccggagcggggccuacguguccgcgaucgcccagacggagaaguccaucgaggacaaccccgagaucgaggacgacaucuuccgcaagaagcggcugaccaucauggaccugcaccccggcgccgggaagaccaagcgcuaccuccccgccaucguccgggaggccaucaagcgcggccugcgcacccugauccuggcgccgacgcgggugguggccgccgagauggaggaggcccuccgcgggcugcccauccgguaccagacccccgccaucaaggcggagcacaccggccgcgagaucgucgaccugaugugccacgccaccuucacgaugcggcuccugagccccgugcgcgugccgaacuacaaccugaucaucauggacgaggcccacuucaccgaccccgccuccaucgccgcgcggggcuacaucagcacccgcgucgagaugggggaggccgccggcaucuucaugaccgccacgccgcccgggucccgggacccguucccccagagcaacgcgcccaucauggacgaggagcgcgagauccccgagcgguccuggaacagcggccacgagugggugaccgacuucaaggggaagaccgugugguucgucccguccaucaaggccggcaacgacaucgccgccugccuccgcaagaacggcaagaaggugauccagcugagccggaagaccuucgacuccgaguacgugaagacgcgcgccaacgacugggacuucgucgugaccaccgacaucagcgagaugggggcgaacuucaaggccgagcgggugaucgacccccgccggugcaugaagcccgucauccugaccgacggcgaggagcgcgugauccucgccgggcccaugccggugacgcacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuacaaggucgcggccgagggcaucaacuacgccgaccgcaaguggugcuucgacgggaucaagaacaaccagauccuggaggagaacguggagguggagaucuggaccaaggagggcgagcggaagaagcucaagccgcgcuggcuggacgcccggaucuacagcgacccccuggcgcucaaggaguucaaggaguucgccgccggccgcaagucccugacgcugaaccucaucaccgagauggggcggcugcccaccuucaugacccagaaggcccgcaacgcccuggacaaccucgcgguccugcacacggccgaggccggcgggcgggccuacaaccacgcccugagcgagcuccccgagacccuggagacccugcuccugcugacccuccuggcgacggugaccggcggcaucuuccuguuccucauguccgggaagggcaucgggaagaugacccugggcaugugcugcaucaucaccgccagcguccugcucugguacgcccagauccagccgcacuggaucgccgccuccaucauccuggaguucuuccugaucgugcuccugauccccgagcccgagaagcagcgcacgccccaggacaaccagcugacguacguggucaucgcgauccucaccgugguggccgccaccauggccaacgagaugggguuccuggagaagaccaagaaggaccugggccucggcagcaucacgacccaggagagcgaguccaacauccuggacaucgaccugcggccggccagcgcguggacccucuacgccgucgccaccacguucgugacccccaugcugcgccacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacgcugaccgccgcccuccugcugcucguggcgcacuacgccaucaucggccccggccugcaggccaaggccacccgggaggcccagaagcgcgcggccgccgggaucaugaagaaccccaccguggacggcaucacggucaucgaccuggagcccaucccguacgaccccaaguucgagaagcagcucggccaggugaugcugcugauccucugcgugacccagguccugaugaugcggaccaccugggcccugugcgaggcccucacgcuggcgaccggccccaucuccacccugugggaggggaaccccggccgcuucuggaacaccacgaucgccgugagcauggccaacaucuuccgcggcuccuaccucgccggggcgggccugcuguucagcaucaugaagaacaccaccaacacccggcgcgggacgggcaacaucggcgagacccucggggagaaguggaagucccggcugaacgcccugggcaagagcgaguuccagaucuacaagaaguccgggauccaggagguggaccgcacccucgccaaggagggcaucaagcgcggggagaccgaccaccacgccgucagccgcggcuccgccaagcugcggugguucguggagcgcaacauggugacgccggagggcaaggucguggaccuggggugcggccgcggcggguggagcuacuacugcggcgggcucaagaacgugcgcgaggucaaggggcugaccaagggcggccccgggcacgaggagcccauccccauguccaccuacggcuggaaccuggugcggcuccagagcgggguggacgucuucuucaccccgcccgagaagugcgacacgcugcugugcgacaucggcgagagcucccccaaccccaccaucgaggcgggccgcacccuccgggugcugaaccugguggagaacuggcucaacaacaacacccaguucugcaucaagguccugaacccguacaugcccagcgugaucgagaagauggagacccugcagcgcaaguacgggggcgcccucgugcggaacccccugucccgcaacagcacgcacgagauguacugggucuccaacgccaccgggaacaucgugagcuccgugaacaugaucagccggaugcugaucaaccgcuucaccaugaagcacaagaaggccaccuacgagccggacgucgaccugggcuccgggacgcggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggugaacggggugguccgccugcugaccaagcccugggacguggugccgauggucacccagauggccaugaccgacacgacccccuucggccagcagcggguguucaaggagaagguggacacccgcacccaggagcccaaggagggcacgaagaagcucaugcggaucaccgccgaguggcuguggaaggagcuggggaagaagaagacgccccggaugugcacccgggaggaguucacgcgcaagguccggagcaacgccgcccucggcgcgaucuucaccgacgagaacaaguggaaguccgcccgcgaggccguggaggacgggcgguucugggagcugguggacaaggagcgcaaccugcaccucgagggcaagugcgagaccugcgucuacaacaugauggggaagcgggagaagaagcugggcgaguucggcaaggccaaggggagccgcgcgaucugguacauguggcugggcgcccgguuccucgaguucgaggcccugggguuccugaacgaggaccacugguucucccgcggcaacagccucagcgggguggagggcgagggccugcaccggcugggguacauccuccgcgacgucggcaagaaggagggcggcgccauguacgccgacgacaccgcggggugggacacgcggaucacccuggaggaccugaagaacgaggagauggugaccaaccacaugaagggcgagcacaagaagcucgccgaggccaucuucaagcugaccuaccagaacaaggugguccgcgugcagcggccgacgccccgcggcaccgugauggacaucaucucccggcgcgaccagcgcgggagcggccaggucgggaccuacggccugaacaccuucacgaacauggaggcccagcucauccggcagauggagggcgaggggaucuucaaguccauccagcaccugaccgccaccgaggagaucgcggugcagaacuggcuggcccgcgugggccgggagcgccucagccggauggccaucuccggggacgacugcgucgugaagcccaucgacgaccgcuucgccagcgcccugaccgcgcugaacgacaugggcaaggugcggaaggacauccagcagugggagcccucccgcggguggaacgacuggacgcaggucccguucugcagccaccacuuccacgagcucgugaugaaggacggccgggugcuggucgugcccugccgcaaccaggacgagcugaucggccgggcccgcaucucccagggggccggcuggagccucaaggagaccgccugccuggggaaguccuacgcccagauguggacccugauguacuuccaccggcgcgaccuccggcuggcggccaacgccaucugcagcgccgugcccucccacuggguccccaccagccgcaccacgugguccauccacgcgaagcacgaguggaugaccaccgaggacaugcuggccguguggaaccggguguggauccaggagaacccguggauggaggacaagacccccgucgagagcugggaggaggugcccuaccucggcaagcgcgaggaccaguggugcgggucccugaucggccugacgagccgggccaccugggccaagaacauccagaccgccaucaaccaggugcgcagccucaucggcaacgaggaguacaccgacuacaugcccuccaugaagcgcuuccggcgcgaggaggaggaggcggggguccugugguga

SEQ ID NO: 9478 - RNA, 9876 nt, Artificial Sequence
  derived and/or modified CDS sequence (opt1) from DENV-2__FJ639734__SS-prME
accgccggcgugaucgucaugcugauccccaccgccaucgcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaccaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgaccugugcgaggggaccacgguggucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacgcgcgugggcaccaagcacgcgauccuccuggucgccgugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugauggugcucaagaucguccgcaacauggagaaguaccagcuggccgugaccaucauggccaucuccugcgugccgaacgccgucauccugcggaacgcguggaaggugagcugcaccauccucgccgccgucuccgugagcccccugcugcucaccuccagccagcagaaggccgacuggaucccccuggcgcugacgaucaagggccucaaccccaccgccaucuuccugaccacccugucccgcacgagcaagaagcgguccuggccgcucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgaggugaagugggaggaccaggccgagaucuccgggagcucccccauccugagcaucacgaucuccgaggacggcagcauguccaucaagaacgaggaggaggagcagacccugaccauccucauccgcaccggccugcuggugaucagcggggucuucccgguguccauccccaucaccgcggccgccugguaccucugggaggugaagaagcagcgggccggcguccugugggacgugcccagcccgccgcccguggggaaggccgagcuggaggacggcgcguaccgcaucaagcagcgggggauccucggcuacucccagaucggcgccggggucuacaaggagggcacguuccacaccauguggcacgugacccgcggggccgugcugaugcaccggggcaagcgcaucgagcccagcugggccgacgucaagaaggaccugaucuccuacgggggcggcuggaagcucgagggggaguggaaggagggcgaggagguccaggugcuggcccuggagcccgggaagaacccccgggcgguccagaccaagcccggcaucuucaagacgaacaccgggaccaucggcgccgugagccucgacuucucccccggcaccagcgggucccccaucguggaccgcaagggcaaggucguggggcuguacggcaacggcguggucacgcggagcggggccuacguguccgccaucgcgcagaccgagaaguccaucgaggacaaccccgagaucgaggacgacaucuuccgcaagaagcggcugaccaucauggaccuccaccccggcgccgggaagaccaagcgcuaccugcccgccaucgugcgggaggccaucaagcgcggccugcgcacgcugauccucgccccgacccgggucguggcggccgagauggaggaggcccugcgcgggcugcccauccgguaccagacccccgccaucaaggccgagcacaccggccgcgagaucguggaccucaugugccacgcgacguucaccaugcggcugcugagccccguccgcgugccgaacuacaaccucaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcugagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccucacggacggcgaggagcgcgucauccuggccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuacaagguggccgcggagggcaucaacuacgccgaccgcaaguggugcuucgacgggaucaagaacaaccagauccucgaggagaacgucgagguggagaucuggacgaaggagggcgagcggaagaagcugaagccgcgcuggcuggacgcccggaucuacagcgacccccucgcccugaaggaguucaaggaguucgcggccggccgcaagucccugacccucaaccugaucaccgagauggggcggcugcccaccuucaugacgcagaaggcccgcaacgcccucgacaaccuggccguccugcacaccgcggaggccggcgggcgggccuacaaccacgcccucagcgagcugcccgagacccuggagacccuccugcugcucacgcugcuggccaccgugaccggcggcaucuuccucuuccugauguccgggaagggcaucgggaagaugacccugggcaugugcugcaucaucaccgcgagcgugcuccugugguacgcccagauccagccgcacuggaucgccgccuccaucauccuggaguucuuccucaucguccugcugauccccgagcccgagaagcagcgcacgccccaggacaaccagcucaccuacguggugaucgccauccugaccgucguggcggccaccauggccaacgagaugggguuccuggagaagacgaagaaggaccucggccugggcagcaucaccacccaggagagcgaguccaacauccuggacaucgaccuccggccggccagcgccuggacccuguacgcgguggccacgaccuucgucacccccaugcugcgccacuccaucgagaacagcuccgugaacgugagccucaccgccaucgccaaccaggcgacgguccugauggggcugggcaagggguggccccucuccaagauggacaucggcgugccccugcuggccaucgggugcuacagccaggugaacccgaucacccucaccgccgcccugcugcuccuggucgcccacuacgcgaucaucggccccggccugcaggccaaggccacccgggaggcccagaagcgcgccgcggccgggaucaugaagaaccccacgguggacggcaucaccgugaucgaccucgagcccaucccguacgaccccaaguucgagaagcagcuggggcaggucaugcugcucauccugugcgugacccaggugcugaugaugcggaccacgugggcccucugcgaggcccugacccuggccaccggccccaucuccacccucugggaggggaaccccggccgcuucuggaacacgaccaucgcggucagcauggccaacaucuuccgcggcuccuaccuggccggggccggccuccuguucagcaucaugaagaacaccaccaacacgcggcgcgggaccggcaacaucggcgagacccugggggagaaguggaagucccggcugaacgcgcucggcaagagcgaguuccagaucuacaagaaguccgggauccaggagguggaccgcacccuggccaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacccaguucugcaucaaggugcugaacccguacaugcccagcgucaucgagaagauggagacgcuccagcgcaaguacgggggcgcgcuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcucaccaagcccugggacgucgugccgauggugacccagauggcgaugacggacaccacccccuucggccagcagcgggucuucaaggagaagguggacacccgcacgcaggagcccaaggagggcaccaagaagcugaugaagaucaccgccgaguggcuguggaaggagcucgggaagaagaagacgccccggaugugcacgcgcgaggaguucacccggaaggugcgcagcaacgccgcccugggcgccaucuucaccgacgagaacaaguggaaguccgcgcgggaggccgucgaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgccaucugguacauguggcucggcgcgcgguuccuggaguucgaggcccugggguuccucaacgaggaccacugguucucccgcggcaacagccugagcgggguggagggcgagggccugcaccggcucggguacauccugcgcgacguguccaagaaggagggcggggccauguacgccgacgacacggccggcugggacacccggaucacccuggaggaccucaagaacgaggagauggucaccaaccacaugaagggggagcacaagaagcuggcggaggccaucuucaagcugacguaccagaacaagguggugcgcguccagcggccgacgccccggggcaccgugauggacaucaucagccggcgcgaccagcgcggcuccggccaggugggcaccuacgggcucaacacguucaccaacauggaggcccagcugauccggcagauggagggcgagggcaucuucaagagcauccagcaccugaccgccaccgaggagaucgccguccagaacuggcucgcgcgcguggggcgggagcgccugucccggauggccaucagcggcgacgacugcguggucaagcccaucgacgaccgcuucgccuccgcccugacggcccucaacgacauggggaaggugcggaaggacauccagcagugggagcccagccgcggcuggaacgacuggacccaggugccguucugcucccaccacuuccacgagcuggucaugaaggacgggcgggcgcugguggugcccugccgcaaccaggacgagcucaucggccgggcccgcaccagccagggcgccggguggucccugaaggagaccgccugccugggcaagagcuacgcccagauguggacccucauguacuuccaccggcgcgaccugcggcuggcggccaacgccaucugcuccgccguccccagccacugggugcccacgucccgcaccaccuggagcauccacgcgaagcacgaguggaugaccacggaggacaugcucgccguguggaaccgggucuggauccaggagaacccguggauggaggacaagacccccguggaguccugggaggaggugcccuaccuggggaagcgcgaggaccaguggugcggcagccugaucgggcucaccagccgggccaccugggccaagaacauccagacggccaucaaccagguccgcucccugaucggcaacgaggaguacaccgacuacaugcccagcaugaagcgcuuccggcgcgaggaggaggaggcgggcgugcugugguga

SEQ ID NO: 9479 - RNA, 9876 nt, Artificial Sequence
  derived and/or modified CDS sequence (opt1) from DENV-2__JN819408__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaccaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggaggucgaggacuacggcuucgggguguucaccaccaacaucuggcucaagcugcgcgagaagcaggacaucuucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggccgugagcuucgucacccugaucaccgggaacauguccuuccgggaccugggccgcgugauggugauggucggggccacgaugaccgacgacaucggcaugggcgugaccuaccucgcccugcuggccgcguucaaggugcgccccaccuucgccgccgggcuccugcugcggaagcucacgagcaaggagcugaugauggccaccaucggcaucgcccugcucucccagagcaccauccccgagaccauccuggagcugacggacgcgcucgcccuggggaugauggcccugaagaucguccgcaacauggagaaguaccagcucgccgugaccaucauggccaucuccugcgugccgaacgcggucauccugcagaacgccuggaaggugagcugcaccauccuggccgccguguccgucagcccccuccugcugaccuccagccagcagaaggcggacuggaucccccucgcccugacgaucaagggccugaaccccaccgccaucuuccucaccacccugucccggacgagcaagaagcgcuccuggccgcugaacgaggccaucauggccgugggcauggucagcauccucgcguccagccugcugaagaacgacauccccaugaccgggccccucguggccggcgggcugcugaccgugugcuacguccucaccggccggagcgccgaccuggagcuggagcgcgccgccgacgugaagugggaggaccaggcggagaucuccgggagcucccccauccucagcaucacgaucuccgaggacggcagcauguccaucaagaacgaggaggaggagcagacccugaccauccugauccggaccggccuccuggugaucagcggggucuucccgguguccauccccaucaccgccgccgccugguaccugugggaggugaagaagcagcgcgccggcguccucugggacgugcccagcccgccgcccguggggaaggcggagcuggaggacggcgccuaccggaucaagcagcgcgggauccugggcuacucccagaucggcgccggggucuacaaggagggcacguuccacaccauguggcacgugacccgcggggccgugcucaugcaccgcggcaagcggaucgagcccagcugggccgacgucaagaaggaccugaucuccuacgggggcggcuggaagcuggagggggaguggaaggagggcgaggagguccaggugcucgcgcuggagcccgggaagaacccccgcgccguccagaccaagcccggcaucuuccggacgaacaccgggaccaucggcgccgugagccuggacuucucccccggcaccagcgggucccccaucguggaccgcaagggcaaggucguggggcucuacggcaacggcguggucacgcggagcggggccuacguguccgcgaucgcccagaccgagaaguccaucgaggacaaccccgagaucgaggacgacaucuuccgcaagaagcggcugaccaucauggaccugcaccccggcgccgggaagaccaagcgcuaccuccccgccaucgugcgggaggccaucaagcgcggccugcgcacgcugauccuggcgccgacccgggucguggccgccgagauggaggaggcccuccgcgggcugcccauccgguaccagacccccgccaucaaggcggagcacaccggccgcgagaucguggaccugaugugccacgccacguucaccaugcggcuccugagccccguccgcgugccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggucaccgacuucaaggggaagaccgugugguucgugccguccaucaaggccggcaacgacaucgccgccugccuccgcaagaacggcaagaaggucauccagcugagccggaagacguucgacuccgaguacgugaagacccgcgccaacgacugggacuucguggucaccaccgacaucagcgagaugggggcgaacuucaaggccgagcgggugaucgacccccgccggugcaugaagcccgugauccugacggacggcgaggagcgcgucauccucgccgggcccaugccggugacccacuccagcgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaagguggacgccaucgacggggaguaccggcugcgcggcgaggcccggaagaccuucgucgaccugaugcgccgcggggaccuccccguguggcuggccuacaagguggcggccgagggcaucaacuacgccgaccgcaaguggugcuucgacgggaucaagaacaaccagauccuggaggagaacgucgagguggagaucuggacgaaggagggcgagcggaagaagcucaagccgcgcuggcuggacgcccggaucuacagcgacccccuggcgcucaaggaguucaaggaguucgccgccggccgcaagucccugacccugaaccucaucaccgagauggggcggcugcccaccuucaugacgcagaaggcccgcaacgcccuggacaaccucgcggugcugcacaccgccgaggccggcgggcgggccuacaaccacgcccugagcgagcuccccgagacccuggagacccugcuccugcugacgcuccuggcgaccgucaccggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggguuccuggagaagacgaagaaggaccugggccucggcagcaucaucacccaggagagcgagaacaacauccuggacaucgaccugcggccggccuccgcguggacccucuacgccguggccaccacguucgugacccccaugcugcgccacagcaucgagaacuccagcgucaacgugucccugaccgccaucgcgaaccaggccaccgugcucauggggcugggcaagggguggccccugagcaagauggacaucggcgucccccuccuggccaucgggugcuacucccaggugaacccgaucacgcugaccgccgcccuccugcugcucguggcgcacuacgccaucaucggccccggccugcaggccaaggccacccgggaggcccagaagcgcgcggccgccgggaucaugaagaaccccaccgucgacggcaucacggugaucgaccuggagcccaucccguacgaccccaaguucgagaagcagcucggccaggugaugcugcugauccucugcgucacccaggugcugaugaugcggaccaccugggcccugugcgaggcccucacgcuggcgaccggccccaucagcacccugugggaggggaaccccggccgcuucuggaacaccacgaucgccguguccauggccaacaucuuccgcggcagcuaccucgccggggcgggccugcuguucuccaucaugaagaacaccaccaacacccggcgcgggacgggcaacaucggcgagacccucggggagaaguggaagucccggcugaacgcccugggcaaguccgaguuccagaucuacaagaaguccgggauccaggaggucgaccgcacccucgccaaggagggcaucaagcgcggggagaccgaccaccacgccgugucccgcggcagcgccaagcugcggugguucguggagcgcaacauggucacgccggagggcaaggugguggaccuggggugcggccgcggcgggugguccuacuacugcggcgggcucaagaacguccgcgaggugaaggggcugaccaagggcggccccgggcacgaggagcccauccccaugagcaccuacggcuggaaccuggugcggcuccaguccggggucgacguguucuucaccccgcccgagaagugcgacacgcugcugugcgacaucggcgagagcagccccaaccccaccaucgaggcgggccgcacccuccgggugcugaaccuggucgagaacuggcucaacaacaacacccaguucugcaucaaggugcugaacccguacaugcccuccgugaucgagaagauggagacccugcagcgcaaguacgggggcgcccucguccggaacccccugagccgcaacuccacgcacgagauguacugggugagcaacgccaccgggaacaucguguccagcgucaacaugaucucccggaugcugaucaaccgcuucaccaugaagcacaagaaggccaccuacgagccggacguggaccugggcagcgggacgcggaacaucggcaucgagggcgagauccccaaccucgacaucaucgggaagcgcaucgagaagaucaagcaggagcacgagaccuccuggcacuacgaccaggaccaccccuacaagaccugggccuaccacggcagcuacgagaccaagcagacgggguccgcgagcuccauggugaacggcgucgugcgccugcugaccaagcccugggacguggucccgauggugacccagauggccaugaccgacacgacccccuucggccagcagcggguguucaaggagaaggucgacacccgcacccaggagcccaaggaggggacgaagaagcucaugaagaucaccgccgaguggcuguggaaggagcugggcaagaagaagacgccccggaugugcacccgcgaggaguucacgaagaaggugcggagcaacgccgcccucggggcgaucuucaccgacgagaacaaguggaaguccgcccgcgaggccguggaggacggccgguucugggagcuggucgaccgcgagcggaaccugcaccucgaggggaagugcgagaccugcguguacaacaugaugggcaagcgcgagaagaagcugggcgaguucgggaaggccaagggcagccgggcgaucugguacauguggcugggggcccgcuuccucgaguucgaggcccugggcuuccugaacgaggaccacugguucucccgggggaacagccucuccggcguggagggcgaggggcugcaccgccugggcuacauccuccgggacgucgggaagaaggagggcggggccauguacgccgacgacaccgcgggcugggacacgcgcaucacccuggaggaccugaagaacgaggagauggugaccaaccacaugaagggcgagcacaagaagcucgccgaggccaucuucaagcugaccuaccagaacaaggucgugcgggugcagcgcccgacgccccgggggaccgucauggacaucaucagccgccgggaccagcgcggcagcggccaggugggcaccuacggccugaacaccuucacgaacauggaggcccagcucauccgccagauggagggggagggcaucuucaaguccauccagcaccugaccgccaccgaggagaucgcggugcagaacuggcuggcccgggucgggcgcgagcggcucagccgcauggccaucuccggcgacgacugcguggugaagcccaucgacgaccgguucgccagcgcccugaccgcgcugaacgacauggggaagguccgcaaggacauccagcagugggagcccucccggggcuggaacgacuggacccaggugccguucugcagccaccacuuccacgagcucgugaugaaggacggccgcguccugguggugcccugccggaaccaggacgagcugaucgggcgcgcccggaucucccagggcgccggguggagccucaaggagaccgccugccugggcaaguccuacgcccagauguggacccugauguacuuccaccgccgggaccuccgccuggcggccaacgccaucugcagcgccguccccucccacugggugcccaccagccggaccacgugguccauccacgcgaagcacgaguggaugaccaccgaggacaugcuggccguguggaaccgcgucuggauccaggagaacccguggauggaggacaagacccccguggagagcugggaggaggugcccuaccucgggaagcgggaggaccaguggugcggcucccugaucggccugacgagccgcgccaccugggccaagaacauccagaccgccaucaaccagguccggucccucaucgggaacgaggaguacaccgacuacaugcccagcaugaagcgcuuccgccgggaggaggaggaggcgggcgugcugugguga

SEQ ID NO: 9480 - RNA, 9876 nt, Artificial Sequence
  derived and/or modified CDS sequence (opt1) from DENV-2__FJ639783__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcgucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucaccgaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagacgaccaugcgcggcgccaagcggauggccauccugggggacaccgccugggacuucggcagccucggcgggguguucaccuccaucgggaaggcccuccaccagguguucggggcgaucuacggcgccgccuucagcggggucuccuggacgaugaagauccugaucggcgugaucaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcacgaagcacgcgauccugcucgucgccgugagcuucgugacccugaucaccgggaacauguccuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccagcaaggagcugaugauggccacgaucggcaucgcccugcucucccagagcaccauccccgagaccauccuggagcugaccgacgcgcucgcccuggggaugauggugcugaagaucguccgcaacauggagaaguaccagcucgccgugacggugauggccaucuccugcgucccgaacgccgugauccugcagaacgcguggaaggucagcugcaccauccuggccgccguguccgugagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgucggcauggugagcauccucgccuccagccugcugaagaacgacauccccaugacggggccccucguggcgggcgggcugcugaccgucugcuacgugcucaccggccggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacgcugaccauccugauccggaccggccuccuggucaucagcgggguguucccgguguccauccccaucaccgcggccgccugguaccugugggaggucaagaagcagcgcgccggcgugcucugggacgugcccagcccgccgcccgucgggaaggccgagcuggaggacggcgcguaccggaucaagcagcgcgggauccugggcuacucccagaucggcgccgggguguacaaggagggcaccuuccacacgauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgcggugcagaccaagcccggcaucuucaagaccaacacggggaccaucggcgccgugagccuggacuucucccccggcaccagcgggucccccaucgucgaccggaagggcaaggugguggggcucuacggcaacggcgucgugacccgcagcggggccuacguguccgccaucgcgcagacggagaaguccaucgaggacaaccccgagaucgaggacgacaucuuccggaagaagcgccugaccaucauggaccugcaccccggcgccgggaagaccaagcgguaccuccccgccaucguccgcgaggccaucaagcggggccugcgcacccugauccuggccccgacgcgcgugguggcggccgagauggaggaggcccuccgggggcugcccauccgcuaccagacccccgccaucaaggccgagcacaccggccgggagaucgucgaccugaugugccacgcgaccuucacgaugcgccuccugagccccgugcgggugccgaacuacaaccugaucaucauggacgaggcccacuucaccgaccccgccuccaucgccgcccgcggcuacaucagcacccgggucgagaugggggaggcggccggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgugugguucgucccguccaucaaggcgggcaacgacaucgccgccugccuccggaagaacggcaagaaggugauccagcugagccgcaagaccuucgacuccgaguacgugaagacgcgggccaacgacugggacuucgucgugaccaccgacaucagcgagaugggggccaacuucaaggcggagcgcgugaucgacccccggcgcugcaugaagcccgucauccugaccgacggcgaggagcgggugauccucgccgggcccaugccggugacgcacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgccgcggagggcaucaacuacgccgaccggaaguggugcuucgacgggaucaagaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgcggccggccggaagucccugacgcugaaccucaucaccgagauggggcgccugcccaccuucaugacccagaaggcccggaacgcccuggacaaccucgccgugcugcacacggcggaggccggcgggcgcgccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgcgagcguccugcucugguacgcccagauccagccgcacuggaucgccgccuccaucauccuggaguucuuccugaucgugcuccugauccccgagcccgagaagcagcggacgccccaggacaaccagcugacguacguggucaucgccauccucaccgugguggcggccaccauggccaacgagaugggguuccuggagaagaccaagaaggaccugggccucggcagcaucacgacccaggagagcgaguccaacauccuggacaucgaccugcgcccggccagcgccuggacccucuacgcggucgccaccacguucgugacccccaugcugcggcacuccaucgagaacagcuccgugaacgucagccugaccgccaucgccaaccaggcgaccgugcucauggggcugggcaagggguggccccuguccaagauggacaucggcgugccccuccuggccaucgggugcuacagccaggucaacccgaucacgcugaccgccgcccuccugcugcucguggcccacuacgcgaucaucggccccggccugcaggccaaggccacccgcgaggcccagaagcgggccgcggccgggaucaugaagaaccccaccguggacggcaucacggucaucgaccuggagcccaucccguacgaccccaaguucgagaagcagcucggccaggugaugcugcugauccucugcgugacccagguccugaugaugcgcaccaccugggcccugugcgaggcccucacgcuggccaccggccccaucuccacccugugggaggggaaccccggccgguucuggaacaccacgaucgcggugagcauggccaacaucuuccgcggcuccuaccucgccggggccggccugcuguucagcaucaugaagaacaccaccaacacccgccgggggacgggcaacaucggcgagacccucggggagaaguggaagucccgccugaacgcgcugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugacgccggagggcaaggucguggaccuggggugcggccgcgggggcuggagcuacuacugcgggggccucaagaacgugcgggaggucaagggccugaccaagggcgggcccgggcacgaggagcccauccccauguccaccuacggcuggaaccuggugcgccuccagagcgggguggacgucuucuucaccccgcccgagaagugcgacacgcugcugugcgacaucggcgagagcucccccaaccccaccaucgaggccggccggacccuccgcgugcugaaccugguggagaacuggcucaacaacaacacccaguucugcaucaagguccugaacccguacaugcccagcgugaucgagaagauggagacccugcagcggaaguacgggggcgcgcucgugcgcaacccccugucccggaacagcacgcacgagauguacugggucuccaacgccaccgggaacaucgugagcuccgugaacaugaucagccgcaugcugaucaaccgguucaccaugaagcacaagaaggccaccuacgagccggacgucgaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggugguccgccugcugaccaagcccugggacguggugccgauggucacccagauggcgaugaccgacacgacccccuucggccagcagcgcguguucaaggagaagguggacacccggacccaggagcccaaggagggcacgaagaagcucaugaagaucaccgccgaguggcuguggaaggagcuggggaagaagaagacgccccgcaugugcacccgggaggaguucacgcgcaagguccggagcaacgccgcccucggcgccaucuucaccgacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacgucggcaagaaggagggcggcgccauguacgccgacgacaccgccgggugggacacgcgcaucacccuggaggaccugaagaacgaggagauggugaccaaccacaugaagggcgagcacaagaagcucgcggaggccaucuucaagcugaccuaccagaacaaggugguccgggugcagcgcccgacgccccggggcaccgugauggacaucaucucccgccgggaccagcgcgggagcggccaggucgggaccuacggccugaacaccuucacgaacauggaggcccagcucauccgccagauggagggcgaggggaucuucaaguccauccagcaccugaccgccaccgaggagaucgccgugcagaacuggcuggcgcgggugggccgcgagcggcucagccgcauggccaucuccggggacgacugcgucgugaagcccaucgacgaccgguucgccagcgcccugaccgcccugaacgacaugggcaaggugcgcaaggacauccagcagugggagcccucccggggguggaacgacuggacgcaggucccguucugcagccaccacuuccacgagcucgugaugaaggacggccgcgugcuggucgugcccugccggaaccaggacgagcugaucggccgcgcgcggaucucccagggggccggcuggagccucaaggagaccgccugccuggggaaguccuacgcccagauguggacccugauguacuuccaccgccgggaccuccgccuggccgcgaacgccaucugcagcgccgugcccucccacuggguccccaccagccggaccacgugguccauccacgccaagcacgaguggaugaccaccgaggacaugcuggcgguguggaaccgcguguggauccaggagaacccguggauggaggacaagacccccgucgagagcugggaggaggugcccuaccucggcaagcgggaggaccaguggugcgggucccugaucggccugacgagccgcgccaccugggccaagaacauccagaccgccaucaaccaggugcggagccucaucggcaacgaggaguacaccgacuacaugcccuccaugaagcgcuuccgccgggaggaggaggaggccgggguccugugguga

SEQ ID NO: 9481 - RNA, 9876 nt, Artificial Sequence
  derived and/or modified CDS sequence (opt1) from DENV-2__FJ639788__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccgccggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggcggccauccuggccuacaccaucgggaccacccacuuccagcgggcccucaucuucauccugcugaccgcgguggcccccagcaugaccaugcgcugcaucggcgucuccaaccgggacuucguggagggcgugagcgggggcuccugggucgacaucgugcucgagcacgggagcugcgugaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccauggucgaccggggcugggggaacggcugcgggcuguucggcaagggcgggaucgugacgugcgccauguucacgugcaagaagaacauggagggcaaggugguccagcccgagaaccuggaguacaccaucgugaucacgccccacagcggggaggagcacgccgugggcaacgacacggggaagcacggcaaggagaucaagaucaccccgcaguccagcaucaccgaggccgagcugaccggguacggcaccgucacgauggagugcagcccccggaccggccucgacuucaacgagauggugcugcugcagauggaggacaaggccuggcucgugcaccggcagugguuccuggaccugccccuccccuggcugccgggggcggacacccagggcagcaacuggauccagaaggagacccuggucacguucaagaacccccacgccaagaagcaggacguggucgugcucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgcggagacccagcacgggaccaucgucauccgcgugcaguacgagggcgacggcucccccugcaagauccccuucgagaucacggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgugaucaucacguggaucgggaugaacagccgcuccaccagccuguccgugagccugguccucgugggcguggucacccuguaccugggggcgauggugcaggccgacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggcgggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgcgaucaaggacaaccgggccgugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgcggggcccgugucccagcacaacuaccgcccgggcuaccacacccagacggccgggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcgcuguuccucgaggagaugcugcggacccgcgugggcaccaagcacgccauccugcucgucgccgugagcuucgugacgcugaucaccgggaacauguccuuccgggaccugggccgcgucauggugauggugggggccaccaugaccgacgacaucggcaugggcgucacguaccucgcccugcuggcggccuucaaggugcgccccaccuucgccgccgggcuccugcugcggaagcucaccagcaaggagcugaugauggccaccaucggcaucgcgcugcucucccagagcacgauccccgagaccauccuggagcugaccgacgcccucgcccuggggaugauggugcugaagaucguccgcaacauggagaaguaccagcucgccgugaccgugauggccaucuccugcgucccgaacgcggugauccugcagaacgccuggaaggucagcugcacgauccuggccgccguguccgugagcccccuccugcugaccuccagccagcagaaggcggacuggaucccccucgcccugaccaucaagggccugaaccccaccgccaucuuccucacgacccugucccggaccagcaagaagcgcuccuggccgcugaacgaggccaucauggccgucggcauggugagcauccucgcguccagccugcugaagaacgacauccccaugaccgggccccucguggccggcgggcugcugacggucugcuacgugcucaccggccggagcgccgaccuggagcuggagcgcgccgccgacgugaagugggaggaccaggcggagaucuccgggagcucccccauccucagcaucaccaucuccgaggacggcagcauguccaucaagaacgaggaggaggagcagacccugacgauccugauccggaccggccuccuggucaucagcgggguguucccgguguccauccccaucaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacaccauguggcacgugacgcgcggggccguccucaugcaccgcggcaagcggaucgagcccagcugggccgacgugaagaaggaccugaucuccuacgggggcggcuggaagcuggagggggaguggaaggagggcgaggaggugcagguccucgcgcuggagcccgggaagaacccccgcgccgugcagaccaagcccggcaucuucaagaccaacaccgggacgaucggcgccgugagccuggacuucucccccggcaccagcgggucccccaucgucgaccggaagggcaaggugguggggcucuacggcaacggcgucgugacccgcagcggggccuacguguccgcgaucgcccagaccgagaaguccaucgaggacaaccccgagaucgaggacgacaucuuccggaagaagcgccugacgaucauggaccugcaccccggcgccgggaagaccaagcgguaccuccccgccaucguccgcgaggccaucaagcggggccugcgcacccugauccuggcgccgacccgcgugguggccgccgagauggaggaggcccuccgggggcugcccauccgcuaccagacgcccgccaucaaggcggagcacaccggccgggagaucgucgaccugaugugccacgccaccuucaccaugcgccuccugagccccgugcgggugccgaacuacaaccugaucaucauggacgaggcccacuucacggaccccgccuccaucgccgcgcgcggcuacaucagcacccgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugacggacuucaaggggaagaccgugugguucgucccguccaucaaggccggcaacgacaucgccgccugccuccggaagaacggcaagaaggugauccagcugagccgcaagaccuucgacuccgaguacgugaagacccgggccaacgacugggacuucgucgugacgaccgacaucagcgagaugggggcgaacuucaaggccgagcgcgugaucgacccccggcgcugcaugaagcccgucauccugaccgacggcgaggagcgggugauccucgccgggcccaugccggugacccacuccagcgccgcccagcgccggggccgcaucgggcgcaaccccaagaacgagaacgaccaguacaucuacaugggcgagccccuggagaacgacgaggacugcgcgcacuggaaggaggccaagaugcugcucgacaacaucaacacgcccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgcggccgagggcaucaacuacgccgaccggaaguggugcuucgacgggaucaagaacaaccagauccuggaggagaacguggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucacggagauggggcgccugcccaccuucaugacccagaaggcccggaacgcccuggacaaccucgcggugcugcacaccgccgaggccggcgggcgcgccuacaaccacgcccugagcgagcuccccgagacgcuggagacccugcuccugcugacccuccuggcgaccgugacgggcggcaucuuccuguuccucauguccgggaagggcaucgggaagaugacccugggcaugugcugcaucaucaccgccagcguccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggguuccuggagaagaccaagaaggaccugggccucggcagcaucaccacgcaggagagcgaguccaacauccuggacaucgaccugcgcccggccagcgcguggacccucuacgccgucgccaccaccuucgugacgcccaugcugcggcacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacccugacggccgcccuccugcugcucguggcgcacuacgccaucaucggccccggccugcaggccaaggccacccgcgaggcccagaagcgggcggccgccgggaucaugaagaaccccaccguggacggcaucaccgucaucgaccuggagcccaucccguacgaccccaaguucgagaagcagcucggccaggugaugcugcugauccucugcgugacgcagguccugaugaugcgcaccaccugggcccugugcgaggcccucacccuggcgacgggccccaucuccacccugugggaggggaaccccggccgguucuggaacaccaccaucgccgugagcauggccaacaucuuccgcggcuccuaccucgccggggcgggccugcuguucagcaucaugaagaacacgaccaacacccgccgggggaccggcaacaucggcgagacgcucggggagaaguggaagucccgccugaacgcccugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugaccccggagggcaaggucguggaccuggggugcggccgcgggggcuggagcuacuacugcgggggccucaagaacgugcgggaggucaagggccugacgaagggcgggcccgggcacgaggagcccauccccauguccaccuacggcuggaaccuggugcgccuccagagcgggguggacgucuucuucaccccgcccgagaagugcgacacccugcugugcgacaucggcgagagcucccccaaccccacgaucgaggcgggccggacccuccgcgugcugaaccugguggagaacuggcucaacuacaacacccaguucugcaucaagguccugaacccguacaugcccagcgugaucgagaagauggagacccugcagcggaaguacgggggcgcccucgugcgcaacccccugucccggaacagcacccacgagauguacugggucuccaacgccacggggaacaucgugagcuccgugaacaugaucagccgcaugcugaucaaccgguucaccaugaagcacaagaaggccaccuacgagccggacgucgaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgcgagcuccauggugaacggggugguccgccugcugacgaagcccugggacguggugccgauggucacccagauggccaugaccgacaccacgcccuucggccagcagcgcguguucaaggagaagguggacacccggacccaggagcccaaggagggcaccaagaagcucaugaagaucacggccgaguggcuguggaaggagcuggggaagaagaagacgccccgcaugugcacccgggaggaguucacccgcaagguccggagcaacgccgcccucggcgcgaucuucacggacgagaacaaguggaaguccgcccgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcgggguggagggcgagggccugcaccgccugggguacauccuccgggacgucggcaagaaggagggcggcgccauguacgccgacgacaccgcggggugggacacccgcaucacgcuggaggaccugaagaacgaggagauggugaccaaccacaugaagggcgagcacaagaagcucgccgaggccaucuucaagcugaccuaccagaacaaggugguccgggugcagcgcccgacgccccggggcacggugauggacaucaucucccgccgggaccagcgcgggagcggccaggucgggaccuacggccugaacaccuucaccaacauggaggcccagcucauccgccagauggagggcgaggggaucuucaaguccauccagcaccugacggccaccgaggagaucgcggugcagaacuggcuggcccgggugggccgcgagcggcucagccgcauggccaucuccggggacgacugcgucgugaagcccaucgacgaccgguucgccagcgcccugaccgcgcugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucggccgcgcccggaucucccagggggccggcuggagccucaaggagacggccugccuggggaaguccuacgcccagauguggacccugauguacuuccaccgccgggaccuccgccuggcggccaacgccaucugcagcgccgugcccucccacuggguccccaccagccggaccaccugguccauccacgcgaagcacgaguggaugacgaccgaggacaugcuggccguguggaaccgcguguggauccaggagaacccguggauggaggacaagacccccgucgagagcugggaggaggugcccuaccucggcaagcgggaggaccaguggugcgggucccugaucggccugaccagccgcgccacgugggccaagaacauccagaccgccaucaaccaggugcggagccucaucggcaacgaggaguacaccgacuacaugcccuccaugaagcgcuuccgccgggaggaggaggaggcggggguccugugguga

SEQ ID NO: 9482 - RNA, 9876 nt, Artificial Sequence
  derived and/or modified CDS sequence (opt1) from DENV-2__FJ639822__SS-prME
accgcgggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcgucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcggccuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaucgaggccgagcugaccggguacggcaccgucacgauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacccuggucacguucaagaacccccacgcgaagaagcaggacguggucgugcucgggucccaggagggcgccaugcacaccgcccugaccggggccaccgagauccagaugagcagcggcaaccuccucuucacgggccaccugaagugccgccugcggauggacaagcuccagcugaaggggauguccuacagcaugugcaccggcaaguucaagaucgugaaggagaucgccgagacccagcacgggaccaucgucauccgcgugcaguacgagggcgacggcucccccugcaagauccccuucgagaucacggaccuggagaagcggcacgugcucgggcgccugaucaccgucaacccgaucgugaccggcaaggacagccccgugaacaucgaggcggagccgcccuucggggacuccuacaucaucaucggcgucgagccggggcagcugaagcucaacugguucaagaagggcagcuccaucggccagauguucgagaccacgaugcgcggggccaagcggauggccauccugggcgacaccgccugggacuucgggagccugggcgggguguucaccuccaucggcaaggcccuccaccagguguucggcgcgaucuacggggccgccuucagcggcgucuccuggaccaugaagauccugaucggggugaucaucacguggaucggcaugaacagccgcuccaccagccuguccgugagccugguccucguggggguggucacccuguaccugggcgccauggugcaggcggacuccggcugcguggucagcuggaagaacaaggagcucaagugcggguccggcaucuucaucaccgacaacgugcacacguggaccgagcaguacaaguuccagcccgagagccccagcaagcuggccuccgccauccagaaggcccacgaggaggggaucugcggcauccggagcgugacccgccuggagaaccucauguggaagcagaucacccccgagcugaaccacauccuguccgagaacgaggucaagcucacgaucaugaccggggacaucaagggcaucaugcaggccggcaagcggagccugcgcccgcagcccaccgagcugaaguacuccuggaagaccugggggaaggcgaagaugcucagcacggagucccacaaccagaccuuccugaucgacggccccgagaccgccgagugcccgaacaccaaccgggccuggaacagccuggagguggaggacuacggguucggcguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacgggguccuggagagcgagaugaucauccccaagaacuucgccggccccgugucccagcacaacuaccgcccgggguaccacacccagacggcgggccccuggcaccucgggaagcuggagauggacuucgacuucugcgagggcaccaccguggucgugaccgaggacugcggcaaccgggggcccagccugcgcacgaccaccgccagcggcaagcucaucaccgaguggugcugccgguccugcacgcugcccccgcugcgcuaccgcggggaggacggcugcugguacgggauggagauccgcccccucaaggagaaggaggagaaccuggugaacagccuggucaccgccggccacggccagaucgacaacuucucccucggggugcugggcauggcccuguuccucgaggagaugcugcggacccgcguggggaccaagcacgcgauccugcucgucgccgugagcuucgugacgcugaucaccggcaacauguccuuccgggaccuggggcgcgucauggugauggugggcgccaccaugaccgacgacaucggcaugggggucacguaccucgcccugcuggccgcguucaaggugcgccccaccuucgccgccggccuccugcugcggaagcucaccagcaaggagcugaugauggccaccaucgggaucgcccugcucucccagagcacgauccccgagaccauccuggagcugaccgacgcgcucgcccugggcaugauggugcugaagaucguccgcaacauggagaaguaccagcucgccgugaccgugauggccaucuccugcgucccgaacgccgugauccugcagaacgcguggaaggucagcugcacgauccuggccgccguguccgugagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgucgggauggugagcauccucgccuccagccugcugaagaacgacauccccaugaccggcccccucguggccggcgggcugcugacggucugcuacgugcucaccgggcggagcgccgaccuggagcuggagcgcgccgccgacgugaagugggaggaccaggccgagaucuccgggagcucccccauccucagcaucaccaucuccgaggacggcagcauguccaucaagaacgaggaggaggagcagacccugacgauccugauccggaccgggcuccuggucaucagcggcguguucccgguguccauccccaucaccgcggccgccugguaccugugggaggucaagaagcagcgcgccggggugcucugggacgugcccagcccgccgcccgucggcaaggccgagcuggaggacggggcguaccggaucaagcagcgcggcauccugggcuacucccagaucggggccggcguguacaaggaggggaccuuccacaccauguggcacgugacgcggggcgccguccucaugcaccgcgggaagcggaucgagcccagcugggccgacgugaagaaggaccugaucuccuacggcggcggguggaagcuggagggcgaguggaaggagggggaggaggugcagguccucgcccuggagcccggcaagaacccccgcgcggugcagaccaagcccgggaucuucaagaccaacaccggcacgaucggcgccgugagccuggacuucucccccgggaccagcggcucccccaucgucgaccggaaggggaagguggugggccucuacggcaacggggucgugacccgcagcggcgccuacguguccgccaucgcgcagaccgagaaguccaucgaggacaaccccgagaucgaggacgacaucuuccggaagaagcgccugacgaucauggaccugcaccccggggccggcaagaccaagcgguaccuccccgccaucguccgcgaggccaucaagcgggggcugcgcacccugauccuggccccgacccgcgugguggcggccgagauggaggaggcccuccggggccugcccauccgcuaccagacgcccgccaucaaggccgagcacaccggccgggagaucgucgaccugaugugccacgcgaccuucaccaugcgccuccugagccccgugcgggugccgaacuacaaccugaucaucauggacgaggcccacuucacggaccccgccuccaucgccgcccgcggguacaucagcacccgggucgagaugggcgaggcggccgggaucuucaugaccgccacgccgcccggcucccgcgacccguucccccagagcaacgcccccaucauggacgaggagcgggagauccccgagcgcuccuggaacagcgggcacgagugggugacggacuucaagggcaagaccgugugguucgucccguccaucaaggcgggcaacgacaucgccgccugccuccggaagaacgggaagaaggugauccagcugagccgcaagaccuucgacuccgaguacgugaagacccgggccaacgacugggacuucgucgugacgaccgacaucagcgagaugggcgccaacuucaaggcggagcgcgugaucgacccccggcgcugcaugaagcccgucauccugaccgacggggaggagcgggugauccucgccggccccaugccggugacccacuccagcgccgcccagcgccgggggcgcaucggccgcaaccccaagaacgagaacgaccaguacaucuacaugggcgagccccuggagaacgacgaggacugcgcccacuggaaggaggcgaagaugcugcucgacaacaucaacacgcccgaggggaucaucccguccauguucgagcccgagcgggagaaggucgacgccaucgacggcgaguaccgccugcgcggggaggcccgcaagaccuucguggaccugaugcggcgcggcgaccuccccguguggcuggccuacaaggucgccgcggaggggaucaacuacgccgaccggaaguggugcuucgacggcaucaagaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgcggccgggcggaagucccuggcccugaaccucaucaccgagaugggccgccugcccacguucaugacccagaaggcccggaacgcccuggacaaccucgcggugcugcacaccgccgaggccgggggccgcgccuacaaccacgcccugagcgagcuccccgagacccuggagacgcugcuccugcugacccuccuggcgaccgugaccggcgggaucuuccuguuccucauguccggcaaggggaucggcaagaugacgcuggggaugugcugcaucaucaccgccagcguccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucaccgugguggccgccacgauggccaacgagaugggcuuccuggagaagaccaagaaggaccugggccucgggagcaucaccacccaggagagcgaguccaacauccuggacaucgaccugcgcccggccagcgcguggacgcucuacgccgucgccaccaccuucgugacccccaugcugcggcacuccaucgagaacagcuccgugaacgucagccugacggccaucgcgaaccaggccaccgugcucaugggccuggggaagggcuggccccuguccaagauggacaucggggugccccuccuggccaucggcugcuacagccaggucaacccgaucacccugaccgccgcccuccugcugcucguggcgcacuacgccaucaucggccccgggcugcaggccaaggccacgcgcgaggcccagaagcgggcggccgccggcaucaugaagaaccccaccguggacgggaucaccgucaucgaccuggagcccaucccguacgaccccaaguucgagaagcagcucggccaggugaugcugcugauccucugcgugacccagguccugaugaugcgcacgaccugggcccugugcgaggcccucacccuggcgaccgggcccaucuccacgcugugggagggcaaccccggccgguucuggaacaccaccaucgccgugagcauggccaacaucuuccgcggguccuaccucgccggcgcggggcugcuguucagcaucaugaagaacaccacgaacacccgccggggcaccggcaacaucggggagacccucggcgagaaguggaagucccgccugaacgcccugggcaagagcgaguuccagaucuacaagaaguccggcauccaggagguggaccggacgcucgccaaggaggggaucaagcgcggcgagaccgaccaccacgccgucagccggggcuccgccaagcugcgcugguucguggagcggaacauggugaccccggaggggaaggucguggaccugggcugcgggcgcggcggguggagcuacuacugcggcggccucaagaacgugcgggaggucaaggggcugaccaagggcgggcccggccacgaggagcccauccccauguccacguacggguggaaccuggugcgccuccagagcggcguggacgucuucuucaccccgcccgagaagugcgacacccugcugugcgacaucggcgagagcucccccaaccccaccaucgaggcggggcggacgcuccgcgugcugaaccugguggagaacuggcucaacaacaacacccaguucugcaucaagguccugaacccguacaugcccagcgugaucgagaagauggagacccugcagcggaaguacggcggggcccucgugcgcaacccccugucccggaacagcacccacgagauguacugggucuccaacgccaccggcaacaucgugagcuccgugaacaugaucagccgcaugcugaucaaccgguucacgaugaagcacaagaaggccaccuacgagccggacgucgaccugggguccggcacccgcaacaucggcaucgagagcgagauccccaaccucgacaucaucgggaagcggaucgagaagaucaagcaggagcacgagaccuccuggcacuacgaccaggaccaccccuacaagacgugggccuaccacggcagcuacgagaccaagcagaccggguccgcgagcuccauggugaacggcgugguccgccugcugaccaagcccugggacguggugccgauggucacgcagauggccaugaccgacaccacccccuucggccagcagcgcguguucaaggagaagguggacacgcggacccaggagcccaaggaggggaccaagaagcucaugaagaucaccgccgaguggcuguggaaggagcugggcaagaagaagacgccccgcaugugcacccgggaggaguucacccgcaagguccggagcaacgccgcccucggggcgaucuucaccgacgagaacaaguggaaguccgcccgcgaggccguggaggacggccgguucugggagcuggucgaccgcgagcggaaccugcaccucgaggggaagugcgagacgugcguguacaacaugaugggcaagcgcgagaagaagcugggcgaguucgggaaggccaagggcagccgggcgaucugguacauguggcugggggcccgcuuccucgaguucgaggcccugggcuuccugaacgaggaccacugguucucccgggggaacagccucagcggcguggagggcgaggggcugcaccgccugggcuacauccuccgggacgucgggaagaaggagggcggggccauguacgccgacgacaccgcgggcugggacacccgcaucacccuggaggaccugaagaacgaggagauggugacgaaccacaugaagggcgagcacaagaagcucgccgaggccaucuucaagcugaccuaccagaacaaggugguccgggugcagcgcccgacgccccgggggaccgugauggacaucaucucccgcaaggaccagcggggcagcgggcaggucggcacguacggccugaacaccuucaccaacauggaggcccagcucauccgccagauggagggggagggcaucuucaaguccauccagcaccugaccgccacggaggagaucgcggugcagaacuggcugacccgcguggggcgggagcgccucagccggauggccaucuccggcgacgacugcgucgugaagcccaucgacgaccgcuucgccagcgcccugaccgcccugaacgacauggggaaggugcggaaggacauccagcagugggagcccucccgcggcuggaacgacuggacccaggucccguucugcagccaccacuuccacgagcucgugaugaaggacggccgggugcuggucgugcccugccgcaaccaggacgagcugaucgggcgggcgcgcaucucccagggcgccggguggagccucaaggagacggccugccugggcaaguccuacgcccagauguggacccugauguacuuccaccggcgcgaccuccggcuggccgcgaacgccaucugcagcgccgugcccucccacuggguccccaccagccgcaccaccugguccauccacgccaagcacgaguggaugacgaccgaggacaugcuggcgguguggaaccggguguggauccaggagaacccguggauggaggacaagacccccgucgagagcugggaggaggugcccuaccucgggaagcgcgaggaccaguggugcggcucccugaucggccugaccagccgggccacgugggccaagaacauccagaccgccaucaaccaggugcgcagccucaucgggaacgaggaguacaccgacuacaugcccuccaugaagcgguuccgccgcgaggaggaggaggccggcguccugugguga

SEQ ID NO: 9483 - RNA, 9876 nt, Artificial Sequence
  derived and/or modified CDS sequence (opt1) from DENV-2__FJ850112__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaucgagaaggacagccccgucaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggccuucaccuccaucgggaaggcgcuccaccagguguucggggccaucuacggcgccgccuucagcggggucuccuggaccaugaagauccugaucggcguggugaucacguggaucgggaugaacagccgcuccaccagccuguccgucagccuggugcucgugggcgucgugacccuguaccugggggcgauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgcgaucaaggacaaccgggccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgcggggcccgugucccagcacaacuaccgcccgggcuaccacacgcagaccgccgggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcgcuguuccucgaggagaugcugcggacccgcgucggcacgaagcacgccauccugcucguggccgugagcuucgucacccugaucaccgggaacauguccuuccgggaccugggccgcgugauggugauggucggggccaccaugacggacgacaucggcaugggcgugaccuaccucgcccugcuggcggccuucaaggugcgccccaccuucgccgccgggcuccugcugcggaagcucaccagcaaggagcugaugauggccacgaucggcaucacccugcucucccagagcaccauccccgagaccauccuggagcugacggacgcgcucgcccuggggaugaugguccugaagaucgugcgcaagauggagaaguaccagcucgccgugaccaucauggccaucuccugcgucccgaacgccgugauccugcggaacgcguggaaggugagcugcaccauccuggccgccgucuccgugagcccccuccugcugaccuccagccagcagaaggccgacuggaucccccucgcgcugacgaucaagggccugaaccccaccgccaucuuccucaccacccugucccgcacgagcaagaagcgguccuggccgcugaacgaggccaucauggccgucggcauggugagcauccucgccuccagccugcugaagaacgacauccccaugaccgggccccucguggcgggcgggcugcugaccgucugcuacgugcucaccggccgcagcgccgaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgcggccgccugguaccugugggaggucaagaagcagcgggccggcgugcucugggacgugcccagcccgccgcccgucgggaaggccgagcuggaggacggcgcguaccgcaucaagcagcgggggauccugggcuacucccagaucggcgccgggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggcggugcagaccaagcccggcaucuucaagacgaacaccgggaccaucggcgccgugagccuggacuucucccccggcaccagcgggucccccaucgucgaccgcaagggcaaggugguggggcucuacggcaacggcgucgugacgcggagcggggccuacguguccgccaucgcgcagaccgagaaguccaucgaggacaaccccgagaucgaggacgacaucuuccgcaagaagcggcugaccaucauggaccugcaccccggcgccgggaagaccaagcgcuaccuccccgccaucguccgggaggccaucaagcgcggccugcgcacgcugauccuggccccgacccgggugguggcggccgagauggaggaggcccuccgcgggcugcccauccgguaccagacccccgccaucaaggccgagcacaccggccgcgagaucgucgaccugaugugccacgcgacguucaccaugcggcuccugagccccgugcgcgugccgaacuacaaccugaucaucauggacgaggcccacuucaccgaccccgccuccaucgccgcccggggcuacaucagcacccgcgucgagaugggggaggcggccggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggcgggcaacgacaucgccgccugccuccgcaagaacggcaagaaggugauccagcugagccggaagacguucgacuccgaguacgugaagacccgcgccaacgacugggacuucgucgugaccaccgacaucagcgagaugggggccaacuucaaggcggagcgggugaucgacccccgccggugcaugaagcccgucauccugacggacggcgaggagcgcgugauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuacaaggucgccgcggagggcaucaacuacgccgaccgcaaguggugcuucgacgggaucaagaacaaccagauccuggaggagaacguggagguggagaucuggacgaaggagggcgagcggaagaagcucaagccgcgcuggcuggacgcccggaucuacagcgacccccuggcccucaaggaguucaaggaguucgcggccggccgcaagucccugacccugaaccucaucaccgagauggggcggcugcccaccuucaugacgcagaaggcccgcaacgcccuggacaaccucgccguccugcacaccgcggaggccggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgcgagcguccugcucugguacgcccagauccagccgcacuggaucgccgccuccaucauccuggaguucuuccugaucgugcuccugauccccgagcccgagaagcagcgcacgccccaggacaaccagcugaccuacguggucaucgccauccucaccgugguggcggccaccauggccaacgagaugggguuccuggagaagacgaagaaggaccugggccucggcagcaucaccacccaggagagcgaguccaacauccuggacaucgaccugcggccggccagcgccuggacccucuacgcggucgccacgaccuucgugacccccaugcugcgccacuccaucgagaacagcuccgugaacgucagccugaccgccaucgccaaccaggcgacggugcucauggggcugggcaagggguggccccuguccaagauggacaucggcgugccccuccuggccaucgggugcuacagccaggucaacccgaucacccugaccgccgcccuccugcugcucguggcccacuacgcgaucaucggccccggccugcaggccaaggccacccgggaggcccagaagcgcgccgcggccgggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucuccacccugugggaggggaaccccggccgcuucuggaacacgaccaucgcggugagcauggccaacaucuuccgcggcuccuaccucgccggggccggccugcuguucagcaucaugaagaacaccaccaacacgcggcgcgggaccggcaacaucggcgagacccucggggagaaguggaagucccggcugaacgcgcugggcaagagcgaguuccagaucuacaagaaguccgggauccaggagguggaccgcacccucgccaaggagggcaucaagcgcggggagacggaccaccacgccgucagccgcggcuccgccaagcugcggugguucguggagcgcaacauggugaccccggagggcaaggucguggaccuggggugcggccgcggcggguggagcuacuacugcggcgggcucaagaacgugcgcgaggucaaggggcugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcgcucgugcggaacccccugucccgcaacagcacccacgagauguacugggucuccaacgccaccgggaacaucgugagcuccgugaacaugaucagccggaugcugaucaaccgcuucaccaugaagcacaagaaggccacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggcgaugacggacaccacccccuucggccagcagcggguguucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaagguccggagcaacgccgcccucggcgccaucuucaccgacgagaacaaguggaaguccgcgcgcgaggccguggaggacgggcgguucugggagcugguggacaaggagcgcaaccugcaccucgagggcaagugcgagaccugcgucuacaacaugauggggaagcgggagaagaagcugggcgaguucggcaaggccaaggggagccgcgccaucugguacauguggcugggcgcgcgguuccucgaguucgaggcccugggguuccugaacgaggaccacugguucucccgcggcaacagccucagcgggguggagggcgagggccugcaccggcugggguacauccuccgcgacgucggcaagaaggagggcggcgccauguacgccgacgacacggccgggugggacacccggaucacccuggaggaccugaagaacgaggagauggugaccaaccacaugaagggcgagcacaagaagcucgcggaggccaucuucaagcugacguaccagaacaaggugguccgcgugcagcggccgacgccccgcggcaccgugauggacaucaucucccggcgcgaccagcgcgggagcggccaggucgggaccuacggccugaacacguucaccaacauggaggcccagcucauccggcagauggagggcgaggggaucuucaaguccauccagcaccugaccgccaccgaggagaucgccgugcagaacuggcuggcgcgcgugggccgggagcgccucagccggauggccaucuccggggacgacugcgucgugaagcccaucgacgaccgcuucgccagcgcccugacggcccugaacgacaugggcaaggugcggaaggacauccagcagugggagcccucccgcggguggaacgacuggacccaggucccguucugcagccaccacuuccacgagcucgugaugaaggacggccgggugcuggucgugcccugccgcaaccaggacgagcugaucggccgggcgcgcaucucccagggggccggcuggagccucaaggagaccgccugccuggggaaguccuacgcccagauguggacccugauguacuuccaccggcgcgaccuccggcuggccgcgaacgccaucugcagcgccgugcccucccacuggguccccaccagccgcacgaccugguccauccacgccaagcacgaguggaugaccaccgaggacaugcuggcgguguggaaccggguguggauccaggagaacccguggauggaggacaagacgcccgucgagagcugggaggaggugcccuaccucggcaagcgcgaggaccaguggugcgggucccugaucggccugaccagccgggccaccugggccaagaacauccagaccgccaucaaccaggugcgcagccucaucggcaacgaggaguacacggacuacaugcccuccaugaagcgcuuccggcgcgaggaggaggaggccgggguccugugguga

SEQ ID NO: 9484 - RNA, 9876 nt, Artificial Sequence
  derived and/or modified CDS sequence (opt1) from DENV-2__FJ850105__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggccgagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcgcuccaccagguguucggggccaucuacggcgccgccuucagcgggguguccuggaccaugaagauccugaucggcgucgugaucacguggaucgggaugaacagccgcuccaccagccuguccgugagccugguccucgugggcguggucacccuguaccugggggcgauggugcaggccgacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgcgaucaaggacaaccgggccgugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgcggggcccgugucccagcacaacuaccgcccgggcuaccacacgcagaccgccgggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcgcuguuccucgaggagaugcugcggacccgcgugggcacgaagcacgccauccugcucgucgccgugagcuucgugacccugaucaccgggaacauguccuuccgggaccugggccgcgucauggugauggugggggccaccaugacggacgacaucggcaugggcgucaccuaccucgcccugcuggcggccuucaaggugcgccccaccuucgccgccgggcuccugcugcggaagcucaccagcaaggagcugaugauggccacgaucggcaucacccugcucucccagagcaccauccccgagaccauccuggagcugacggacgcgcucgcccuggggaugauggugcugaagaucguccgcaacauggagaaguaccagcucgccgugaccaucauggccaucuccugcgugccgaacgccgucauccugcggaacgcguggaaggugagcugcaccauccuggccgccguguccgucagcccccuccugcugaccuccagccagcagaaggccgacuggaucccccucgcgcugacgaucaagggccugaaccccaccgccaucuuccucaccacccugucccgcacgagcaagaagcgguccuggccgcugaacgaggccaucauggccgugggcauggucagcauccucgccuccagccugcugaagaacgacauccccaugaccgggccccucguggcgggcgggcugcugaccgugugcuacguccucaccggccgcagcgccgaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggugaucagcggggucuucccgguguccauccccaucaccgcggccgccugguaccugugggaggugaagaagcagcgggccggcguccucugggacgugcccagcccgccgcccguggggaaggccgagcuggaggacggcgcguaccgcaucaagcagcgggggauccugggcuacucccagaucggcgccggggucuacaaggagggcacguuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggcaucuucaagacgaacaccgggaccaucggcgccgugagccuggacuucucccccggcaccagcgggucccccaucguggaccgcaagggcaaggucguggggcucuacggcaacggcguggucacgcggagcggggccuacguguccgccaucgcgcagaccgagaaguccaucgaggacaaccccgagaucgaggacgacaucuuccgcaagaagcggcugaccaucauggaccugcaccccggcgccgggaagaccaagcgcuaccuccccgccaucgugcgggaggccaucaagcgcggccugcgcacgcugauccuggccccgacccgggucguggcggccgagauggaggaggcccuccgcgggcugcccauccgguaccagacccccgccaucaaggccgagcacaccggccgcgagaucguggaccugaugugccacgcgacguucaccaugcggcuccugagccccguccgcgugccgaacuacaaccugaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccuccgcaagaacggcaagaaggucauccagcugagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccugacggacggcgaggagcgcgucauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgcgagaagguggacgccaucgacggggaguaccggcugcgcggcgaggcccggaagaccuucgucgaccugaugcgccgcggggaccuccccguguggcuggccuacaagguggccgcggagggcaucaacuacgccgaccgcaaguggugcuucgacgggaucaagaacaaccagauccuggaggagaacgucgagguggagaucuggacgaaggagggcgagcggaagaagcucaagccgcgcuggcuggacgcccggaucuacagcgacccccuggcccucaaggaguucaaggaguucgcggccggccgcaagucccugacccugaaccucaucaccgagauggggcggcugcccaccuucaugacgcagaaggcccgcaacgcccuggacaaccucgccgugcugcacaccgcggaggccggcgggcgggccuacaaccacgcccugagcgagcuccccgagacccuggagacccugcuccugcugacgcuccuggccaccgucaccggcggcaucuuccuguuccucauguccgggaagggcaucgggaagaugacccugggcaugugcugcaucaucaccgcgagcgugcugcucugguacgcccagauccagccgcacuggaucgccgccuccaucauccuggaguucuuccugaucguccuccugauccccgagcccgagaagcagcgcacgccccaggacaaccagcugaccuacguggugaucgccauccucaccgucguggcggccaccauggccaacgagaugggguuccuggagaagacgaagaaggaccugggccucggcagcaucaccacccaggagagcgaguccaacauccuggacaucgaccugcggccggccagcgccuggacccucuacgcgguggccacgaccuucgucacccccaugcugcgccacuccaucgagaacagcuccgugaacgugagccugaccgccaucgccaaccaggcgacgguccucauggggcugggcaagggguggccccuguccaagauggacaucggcgugccccuccuggccaucgggugcuacagccaggugaacccgaucacccugaccgccgcccuccugcugcucgucgcccacuacgcgaucaucggccccggccugcaggccaaggccacccgggaggcccagaagcgcgccgcggccgggaucaugaagaaccccacgguggacggcaucaccgugaucgaccuggagcccaucccguacgaccccaaguucgagaagcagcucgggcaggucaugcugcugauccucugcgugacccaggugcugaugaugcggaccacgugggcccugugcgaggcccucacccuggccaccggccccaucuccacccugugggaggggaaccccggccgcuucuggaacacgaccaucgcggucagcauggccaacaucuuccgcggcuccuaccucgccggggccggccugcuguucagcaucaugaagaacaccaccaacacgcggcgcgggaccggcaacaucggcgagacccucggggagaaguggaagucccggcugaacgcgcugggcaagagcgaguuccagaucuacaagaaguccgggauccaggagguggaccgcacccucgccaaggagggcaucaagcgcggggagacggaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugaccaagggcggccccgggcacgaggagcccauccccauguccaccuacggcuggaaccugguccggcuccagagcgggguggacguguucuucacgccgcccgagaagugcgacacccugcugugcgacaucggcgagagcucccccaaccccaccaucgaggccggccgcacccuccggguccugaaccugguggagaacuggcucaacaacaacacccaguucugcaucaaggugcugaacccguacaugcccagcgucaucgagaagauggagacgcugcagcgcaaguacgggggcgcgcucgugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcugaccaagcccugggacgucgugccgauggugacccagauggcgaugacggacaccacccccuucggccagcagcgggucuucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaaggugcggagcaacgccgcccucggcgccaucuucaccgacgagaacaaguggaaguccgcgcgcgaggccgucgaggacgggcgguucugggagcugguggacaaggagcgcaaccugcaccucgagggcaagugcgagaccugcguguacaacaugauggggaagcgggagaagaagcugggcgaguucggcaaggccaaggggagccgcgccaucugguacauguggcugggcgcgcgguuccucgaguucgaggcccugggguuccugaacgaggaccacugguucucccgcggcaacagccucagcggggucgagggcgagggccugcaccggcugggguacauccuccgcgacgugggcaagaaggagggcggcgccauguacgccgacgacacggccgggugggacacccggaucacccuggaggaccugaagaacgaggagauggucaccaaccacaugaagggcgagcacaagaagcucgcggaggccaucuucaagcugacguaccagaacaagguggugcgcguccagcggccgacgccccgcggcaccgugauggacaucaucucccggcgcgaccagcgcgggagcggccagguggggaccuacggccugaacacguucaccaacauggaggcccagcucauccggcagauggagggcgaggggaucuucaaguccauccagcaccugaccgccaccgaggagaucgccguccagaacuggcuggcgcgcgugggccgggagcgccucagccggauggccaucuccggggacgacugcguggucaagcccaucgacgaccgcuucgccagcgcccugacggcccugaacgacaugggcaaggugcggaaggacauccagcagugggagcccucccgcggguggaacgacuggacccaggugccguucugcagccaccacuuccacgagcucgucaugaaggacggccgggugcuggugguccccugccgcaaccaggacgagcugaucggccgggcgcgcaucucccagggggccggcuggagccucaaggagaccgccugccuggggaaguccuacgcccagauguggacccugauguacuuccaccggcgcgaccuccggcuggccgcgaacgccaucugcagcgccgugcccucccacugggugcccaccagccgcacgaccugguccauccacgccaagcacgaguggaugaccaccgaggacaugcuggcggucuggaaccggguguggauccaggagaacccguggauggaggacaagacgcccguggagagcugggaggagguccccuaccucggcaagcgcgaggaccaguggugcgggucccugaucggccugaccagccgggccaccugggccaagaacauccagaccgccaucaaccaggugcgcagccucaucggcaacgaggaguacacggacuacaugcccuccaugaagcgcuuccggcgcgaggaggaggaggccggggugcugugguga

SEQ ID NO: 9485 - RNA, 9876 nt, Artificial Sequence
  derived and/or modified CDS sequence (opt1) from DENV-2__FJ850106__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgacccugcucguggccgccagcuucgugacccugaucaccgggaacauguccuuccgggaccugggccgcgucauggugauggugggggccacgaugaccgacgacaucggcaugggcgucaccuaccucgcccugcuggcggccuucaaggugcgccccaccuucgccgccgggcuccugcugcggaagcucacgagcaaggagcugaugauggccaccaucggcaucacccugcucucccagagcaccauccccgagacgauccuggagcugaccgacgcgcucgcccuggggaugauggugcugaagaucguccgcaacauggagaaguaccagcucgccgugaccaucauggccaucuccugcgugccgaacgccgucauccugcggaacgcguggaaggugagcugcaccauccuggccgccguguccgucagcccccuccugcugacguccagccagcagaaggccgacuggaucccccucgcgcugaccaucaagggccugaaccccaccgccaucuuccucaccacgcugucccgcaccagcaagaagcgguccuggccgcugaacgaggccaucauggccgugggcauggucagcauccucgccuccagccugcugaagaacgacauccccaugaccgggccccucguggcgggcgggcugcugaccgugugcuacguccucacgggccgcagcgccgaccuggagcuggagcgggccgccgacgugaagugggaggaccaggccgagaucuccgggagcucccccauccucagcaucaccaucuccgaggacggcagcauguccaucaagaacgaggaggaggagcagacccugaccauccugauccgcaccggccuccuggugaucagcggggucuucccgguguccauccccaucacggcggccgccugguaccugugggaggugaagaagcagcgggccggcguccucugggacgugcccagcccgccgcccguggggaaggccgagcuggaggacggcgcguaccgcaucaagcagcgggggauccugggcuacucccagaucggcgccggggucuacaaggagggcaccuuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagacgaagcccggcaucuucaagaccaacaccgggaccaucggcgccgugagccuggacuucucccccggcacgagcgggucccccaucguggaccgcaagggcaaggucguggggcucuacggcaacggcguggucacccggagcggggccuacguguccgccaucgcgcagaccgagaaguccaucgaggacaaccccgagaucgaggacgacaucuuccgcaagaagcggcugaccaucauggaccugcaccccggcgccgggaagacgaagcgcuaccuccccgccaucgugcgggaggccaucaagcgcggccugcgcacccugauccuggccccgacccgggucguggcggccgagauggaggaggcccuccgcgggcugcccauccgguaccagacccccgccaucaaggccgagcacacgggccgcgagaucguggaccugaugugccacgcgaccuucaccaugcggcuccugagccccguccgcgugccgaacuacaaccugaucaucauggacgaggcccacuucaccgaccccgccuccaucgccgcccggggcuacaucagcacgcgcguggagaugggggaggcggccggcaucuucaugaccgccacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggcgggcaacgacaucgccgccugccuccgcaagaacggcaagaaggucauccagcugagccggaagaccuucgacuccgaguacgugaagacccgcgccaacgacugggacuucguggucaccacggacaucagcgagaugggggccaacuucaaggcggagcgggugaucgacccccgccggugcaugaagcccgugauccugaccgacggcgaggagcgcgucauccucgccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgcgagaagguggacgccaucgacggggaguaccggcugcgcggcgaggcccggaagacguucgucgaccugaugcgccgcggggaccuccccguguggcuggccuacaagguggccgcggagggcaucaacuacgccgaccgcaaguggugcuucgacgggaucaagaacaaccagauccuggaggagaacgucgagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucaccgagauggggcggcugcccacguucaugacccagaaggcccgcaacgcccuggacaaccucgccgugcugcacaccgcggaggccggcgggcgggccuacaaccacgcccugagcgagcuccccgagacccuggagacgcugcuccugcugacccuccuggccaccgucaccggcggcaucuuccuguuccucauguccgggaagggcaucgggaagaugacccugggcaugugcugcaucaucacggcgagcgugcugcucugguacgcccagauccagccgcacuggaucgccgccuccaucauccuggaguucuuccugaucguccuccugauccccgagcccgagaagcagcgcacgccccaggacaaccagcugaccuacguggugaucgccauccucaccgucguggcggccacgauggccaacgagaugggguuccuggagaagaccaagaaggaccugggccucggcagcaucaccacccaggagagcgaguccaacauccuggacaucgaccugcggccggccagcgccuggacgcucuacgcgguggccaccaccuucgucacccccaugcugcgccacuccaucgagaacagcuccgugaacgugagccugacggccaucgccaaccaggcgaccguccucauggggcugggcaagggguggccccuguccaagauggacaucggcgugccccuccuggccaucgggugcuacagccaggugaacccgaucacccugaccgccgcccuccugcugcucgucgcccacuacgcgaucaucggccccggccugcaggccaaggccacgcgggaggcccagaagcgcgccgcggccgggaucaugaagaaccccaccguggacggcaucaccgugaucgaccuggagcccaucccguacgaccccaaguucgagaagcagcucgggcaggucaugcugcugauccucugcgugacccaggugcugaugaugcggacgaccugggcccugugcgaggcccucacccuggccaccggccccaucuccacgcugugggaggggaaccccggccgcuucuggaacaccaccaucgcggucagcauggccaacaucuuccgcggcuccuaccucgccggggccggccugcuguucagcaucaugaagaacaccacgaacacccggcgcgggaccggcaacaucggcgagacccucggggagaaguggaagucccggcugaacgcgcugggcaagagcgaguuccagaucuacaagaaguccgggauccaggagguggaccgcacgcucgccaaggagggcaucaagcgcggggagaccgaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugaccaagggcggccccgggcacgaggagcccauccccauguccacguacggcuggaaccugguccggcuccagagcgggguggacguguucuucaccccgcccgagaagugcgacacccugcugugcgacaucggcgagagcucccccaaccccaccaucgaggccggccgcacccuccggguccugaaccugguggagaacuggcucaacaacaacacgcaguucugcaucaaggugcugaacccguacaugcccagcgucaucgagaagauggagacccugcagcgcaaguacgggggcgcgcucgugcggaacccccugucccgcaacagcacccacgagauguacuggguguccaacgccaccgggaacaucgucagcuccgugaacaugaucagccggaugcugaucaaccgcuucacgaugaagcacaagaaggccaccuacgagccggacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggucaacgggguggugcgccugcugaccaagcccugggacgucgugccgauggugacgcagauggcgaugaccgacaccacccccuucggccagcagcgggucuucaaggagaagguggacacgcgcacccaggagcccaaggagggcaccaagaagcucaugcggaucaccgccgaguggcuguggaaggagcuggggaagaagaagacgccccgcaugugcacccgggaggaguucacccgcaaggugcggagcaacgccgcccucggcgccaucuucaccgacgagaacaaguggaaguccgcgcgcgaggccgucgaggacgggcgguucugggagcugguggacaaggagcgcaaccugcaccucgagggcaagugcgagacgugcguguacaacaugauggggaagcgggagaagaagcugggcgaguucggcaaggccaaggggagccgcgccaucugguacauguggcugggcgcgcgguuccucgaguucgaggcccugggguuccugaacgaggaccacugguucucccgcggcaacagccucagcggggucgagggcgagggccugcaccggcugggguacauccuccgcgacgugggcaagaaggagggcggcgccauguacgccgacgacaccgccgggugggacacccggaucacccuggaggaccugaagaacgaggagauggucacgaaccacaugaagggcgagcacaagaagcucgcggaggccaucuucaagcugaccuaccagaacaagguggugcgcguccagcggccgacgccccggggcaccgugauggacaucaucucccggcgcgaccagcgcgggagcggccagguggggacguacggccugaacaccuucaccaacauggaggcccagcucauccggcagauggagggcgaggggaucuucaaguccauccagcaccugaccgccacggaggagaucgccguccagaacuggcuggcgcgcgugggccgggagcgccucagccggauggccaucuccggggacgacugcguggucaagcccaucgacgaccgcuucgccagcgcccugaccgcccugaacgacaugggcaaggugcggaaggacauccagcagugggagcccucccgcggguggaacgacuggacccaggugccguucugcagccaccacuuccacgagcucgucaugaaggacggccgggugcuggugguccccugccgcaaccaggacgagcugaucggccgggcgcgcaucucccagggggccggcuggagccucaaggagaccgccugccuggggaaguccuacgcccagauguggacccugauguacuuccaccggcgcgaccuccggcuggccgcgaacgccaucugcagcgccgugcccucccacugggugcccacgagccgcaccaccugguccauccacgccaagcacgaguggaugaccacggaggacaugcuggcggucuggaaccggguguggauccaggagaacccguggauggaggacaagacccccguggagagcugggaggagguccccuaccucggcaagcgcgaggaccaguggugcgggucccugaucggccugaccagccgggccaccugggccaagaacauccagacggccaucaaccaggugcgcagccucaucggcaacgaggaguacaccgacuacaugcccuccaugaagcgcuuccggcgcgaggaggaggaggccggggugcugugguga

SEQ ID NO: 9486 - RNA, 9876 nt, Artificial Sequence
  derived and/or modified CDS sequence (opt1) from DENV-2__FJ850107__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccguguucccccuccugcugaccagcucccagcagaaggccgacuggaucccccucgcccugacgaucaagggccugaaccccaccgcgaucuuccucaccacccugagccgcacguccaagaagcggagcuggccgcugaacgaggccaucauggccgucggcaugguguccauccucgccagcucccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucagcggguccagccccauccucuccaucacgaucagcgaggacggcuccaugagcaucaagaacgaggaggaggagcagacccugaccauccugauccgcaccggccuccuggucaucuccgggguguucccggugagcauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacagccagaucggcgcggggguguacaaggagggcacguuccacaccauguggcacgugacccgcggggccguccucaugcaccggggcaagcgcaucgagcccuccugggccgacgugaagaaggaccugaucagcuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugucccuggacuucagccccggcaccuccgggagccccaucgucgaccgcaagggcaaggugguggggcucuacggcaacggcgucgugacgcgguccggggccuacgugagcgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccagcaucgccgcccggggcuacaucuccacccgcgucgagaugggggaggccgcgggcaucuucaugacggccacgccgcccgggagccgggacccguucccccaguccaacgcccccaucauggacgaggagcgcgagauccccgagcggagcuggaacuccggccacgagugggugaccgacuucaaggggaagaccgugugguucgucccgagcaucaaggccggcaacgacaucgcggccugccuccgcaagaacggcaagaaggugauccagcugucccggaagacguucgacagcgaguacgugaagacccgcgccaacgacugggacuucgucgugaccaccgacaucuccgagaugggggccaacuucaaggccgagcgggugaucgacccccgccggugcaugaagcccgucauccugacggacggcgaggagcgcgugauccucgcggggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggagguggagaucuggacgaaggagggcgagcggaagaagcucaagccgcgcuggcuggacgcccggaucuacuccgacccccuggcccucaaggaguucaaggaguucgccgcgggccgcaagagccugacccugaaccucaucaccgagauggggaagcugcccaccuucaugacgcagaaggcccggaacgcccuggacaaccucgccguccugcacaccgccgaggcgggcgggcgcgccuacaaccacgcccuguccgagcuccccgagacccuggagacccugcuccugcugacgcuccuggccaccgugaccggcggcaucuuccuguuccucaugagcgggaagggcaucgggaagaugacccugggcaugugcugcaucaucaccgccuccguccugcucugguacgcgcagauccagccgcacuggaucgccgccagcaucauccuggaguucuuccugaucgugcuccugauccccgagcccgagaagcagcggacgccccaggacaaccagcugaccuacguggucaucgccauccucaccgugguggccgcgaccauggccaacgagaugggguuccuggagaagacgaagaaggaccugggccucggcuccaucaccacccaggagagcgagagcaacauccuggacaucgaccugcgcccggccuccgccuggacccucuacgccgucgcgacgaccuucgugacccccaugcugcggcacagcaucgagaacuccagcgugaacgucucccugaccgccaucgccaaccaggccacggugcucauggggcugggcaagggguggccccugagcaagauggacaucggcgugccccuccuggcgaucgggugcuacucccaggucaacccgaucacccugaccgccgcccuccugcugcucguggcccacuacgccaucaucggccccggccugcaggcgaaggccacccgcgaggcccagaagcgggccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcgcaccacgugggcccugugcgaggcccucacccuggccaccggccccaucagcacccugugggaggggaaccccggccgguucuggaacacgaccaucgccguguccauggcgaacaucuuccgcggcagcuaccucgccggggccggccugcuguucuccaucaugaagaacaccaccaacacgcgccgggggaccggcaacaucggcgagacccucggggagaaguggaagucccgccugaacgcccugggcaaguccgaguuccagaucuacaagaaguccgggauccaggagguggaccggacccucgcgaaggagggcaucaagcgcggggagacggaccaccacgccgucucccggggcagcgccaagcugcgcugguucguggagcggaacauggugaccccggagggcaaggucguggaccuggggugcggccgcgggggcugguccuacuacugcgggggccucaagaacgugcgggaggucaagggccugaccaagggcgggcccgggcacgaggagcccauccccaugagcaccuacggcuggaaccuggugcgccuccaguccgggguggacgucuucuucacgccgcccgagaagugcgacacccugcugugcgacaucggcgagagcagccccaaccccaccaucgaggccggccggacccuccgcgugcugaaccugguggagaacuggcucaacaacaacacccaguucugcaucaagguccugaacccguacaugcccuccgugaucgagaagauggagacgcugcagcggaaguacgggggcgcccucgugcgcaacccccugagccggaacuccacccacgagauguacugggucagcaacgcgaccgggaacaucguguccagcgugaacaugaucucccgcaugcugaucaaccgguucaccaugaagcacaagaaggccacguacgagccggacgucgaccugggcagcgggacccgcaacaucggcaucgaguccgagauccccaaccucgacaucaucggcaagcggaucgagaagauccgccaggagcacgagaccagcuggcacuacgaccaggaccaccccuacaagaccugggccuaccacggguccuacgagacgaagcagaccggcagcgccuccagcauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgcggaguggcuguggaaggagcuggggaagaagaagacgccccgcaugugcacgcgggaggaguucacccgcaagguccgguccaacgccgcccucggcgccaucuucaccgacgagaacaaguggaaguccgcccgcgaggcgguggaggacgggcgguucugggagcugguggacaaggagcgcaaccugcaccucgagggcaagugcgagaccugcgucuacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcggcaacucccucagcgggguggagggcgagggccugcaccggcugggguacauccuccgcgacgucggcaagaaggagggcggggccauguacgccgacgacacggccgggugggacacccggaucacccuggaggaccugaagaacgaggagauggugaccaaccacaugaagggcgagcacaagaagcucgccgaggcgaucuucaagcugacguaccagaacaaggugguccgcgugcagcggccgacgccccgcggcaccgugauggacaucaucagccggcgcgaccagcgcggguccggccaggucgggaccuacggccugaacacguucaccaacauggaggcccagcucauccggcagauggagggcgaggggaucuucaagagcauccagcaccugaccgccaccgaggagaucgccgugcagaacuggcuggcccgcgugggccgggagcgccucucccggauggcgaucagcggggacgacugcgucgugaagcccaucgacgaccgcuucgccuccgcccugacggcccugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucggccgggcccgcaucagccagggggcgggcuggucccucaaggagaccgccugccugggcaagagcuacgcccagauguggacccugauguacuuccaccggcgcgaccuccggcuggccgccaacgcgaucugcuccgccgugcccagccacuggguccccaccucccgcacgaccuggagcauccacgccaagcacgaguggaugaccaccgaggacaugcuggccguguggaaccggguguggauccaggagaacccguggauggaggacaagacgcccgucgaguccugggaggaggugcccuaccucggcaagcgcgaggaccaguggugcgggagccugaucggccugaccucccgggcgaccugggccaagaacauccagaccgccaucaaccaggugcgcagccucaucggcaacgaggaguacacggacuacaugcccagcaugaagcgcuuccggcgcgaggaggaggaggccgggguccugugguga

SEQ ID NO: 9487 - RNA, 9876 nt, Artificial Sequence
  derived and/or modified CDS sequence (opt1) from DENV-2__FJ850108__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcagcgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaucgcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcaccaagcacgcgauccugcucgucgccgugagcuucgugacgcugaucaccgggaacauguccuuccgggaccugggccgcaugauggucauggugggggccaccaugaccgacgacaucggcaugggcgugacguaccucgcccugcuggccgcguucaagguccgccccaccuucguggccgggcuccugcugcggaagcucaccagcaaggagcugaugauggccaccaucggcaucacgcugcucucccagagcaccauccccgagaccauccuggagcugaccgacgcccucgcccuggggaugauggugcugaagaucguccgcaacauggagaaguaccagcucgcggugacgaucauggccaucuccugcgugccgaacgccgucauccugcggaacgccuggaaggugagcugcaccauccuggccgcggucuccgugagcccccuccugcugaccuccagccagcagaaggccgacuggaucccccucgcccugaccaucaagggccugaaccccacggccaucuuccucaccacccugucccgcaccagcaagaagcgguccuggccgcugaacgaggcgaucauggccgugggcauggucagcauccucgccuccagccugcugaagaacgacauccccaugacggggccccucguggccggcgggcugcugaccgugugcuacguccucaccggccgcagcgccgaccuggagcuggagcgggcggccgacgugaagugggaggaccaggccgagaucuccgggagcucccccauccucagcaucaccaucuccgaggacggcagcauguccaucaagaacgaggaggaggagcagacgcugaccauccugauccgcaccggccuccuggugaucagcggggucuucccgguguccauccccaucaccgccgccgcgugguaccugugggaggugaagaagcagcgggccggcguccucugggacgugcccagcccgccgcccguggggaaggccgagcuggaggacggcgccuaccgcaucaagcagcgggggauccugggcuacucccagaucggcgccggggucuacaaggagggcaccuuccacacgauguggcacgugacccgcggggcggugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggccguccagaccaagcccggcaucuucaagaccaacacggggaccaucggcgccgugagccuggacuucucccccggcaccagcgggucccccaucguggaccgcaagggcaaggucguggggcucuacggcaacggcguggucacccggagcggggcguacguguccgccaucgcccagacggagaaguccaucgaggacaaccccgagaucgaggacgacaucuuccgcaagaagcggcugaccaucauggaccugcaccccggcgccgggaagaccaagcgcuaccuccccgcgaucgugcgggaggccaucaagcgcggccugcgcacccugauccuggccccgacgcgggucguggccgccgagauggaggaggcgcuccgcgggcugcccauccgguaccagacccccgccaucaaggccgagcacaccggccgcgagaucguggaccugaugugccacgccaccuucacgaugcggcuccugagccccguccgcgugccgaacuacaaccugaucaucauggacgaggcccacuucaccgaccccgcguccaucgccgcccggggcuacaucagcacccgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggccggcaacgacaucgccgcgugccuccgcaagaacggcaagaaggucauccagcugagccggaagaccuucgacuccgaguacgugaagacgcgcgccaacgacugggacuucguggucaccaccgacaucagcgagaugggggccaacuucaaggccgagcgggugaucgacccccgccggugcaugaagcccgugauccugaccgacggcgaggagcgcgucauccucgccgggcccaugccggugacgcacuccagcgcggcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaagguggacgccaucgacggggaguaccggcugcgcggcgaggcgcggaagaccuucgucgaccugaugcgccgcggggaccuccccguguggcuggccuacaagguggccgccgagggcaucaacuacgccgaccgcaaguggugcuucgacgggaucaagaacaaccagauccuggaggagaacgucgagguggagaucuggaccaaggagggcgagcggaagaagcucaagccgcgcuggcuggacgcgcggaucuacagcgacccccuggcccucaaggaguucaaggaguucgccgccggccgcaagucccugacgcugaaccucaucaccgagauggggcggcugcccaccuucaugacccagaaggcgcgcaacgcccuggacaaccucgccguccugcacacggccgaggccggcgggcgggcguacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgccagcgugcugcucugguacgcccagauccagccgcacuggaucgcggccuccaucauccuggaguucuuccugaucguccuccugauccccgagcccgagaagcagcgcacgccccaggacaaccagcugacguacguggugaucgccauccucaccgucguggccgccaccauggcgaacgagaugggguuccuggagaagaccaagaaggaccugggccucggcagcaucacgacccaggagccggagagcaacauccuggacaucgaccugcggcccgccuccgccuggacccucuacgccguggccaccacguucgucacccccaugcugcgccacagcaucgagaacuccagcgugaacgugucccugaccgcgaucgccaaccaggccaccguccucauggggcugggcaagggguggccccugagcaagauggacaucggcgugccgcuccuggccaucgggugcuacucccaggugaaccccaucacgcugaccgcggcccuccugcugcucgucgcccacuacgccaucaucggccccggccugcaggccaaggcgacccgggaggcccagaagcgcgccgccgccgggaucaugaagaaccccaccguggacggcaucacggugaucgaccuggagccgauccccuacgaccccaaguucgagaagcagcucgggcaggucaugcugcugauccucugcgugacccaggugcugaugaugcggaccaccugggcgcugugcgaggcccucacgcuggccaccggccccaucagcacccugugggaggggaacccgggccgcuucuggaacaccacgaucgccgucuccauggccaacaucuuccgcggcagcuaccucgcgggggccggccugcuguucuccaucaugaagaacaccaccaacacccggcgcgggacgggcaacaucggcgagacccucggggagaaguggaagucccggcugaacgcccugggcaaguccgaguuccagaucuacaagaaguccgggauccaggagguggaccgcacccucgccaaggagggcaucaagcgcggggagaccgaccaccacgcggugucccgcggcagcgccaagcugcggugguucgucgagcgcaacauggugacgcccgagggcaagguggucgaccuggggugcggccgcggcgggugguccuacuacugcggcgggcucaagaacgugcgcgaggugaaggggcugaccaagggcggccccgggcacgaggagcccaucccgaugagcaccuacggcuggaaccugguccggcuccaguccgggguggacguguucuucacgccgcccgagaagugcgacacgcugcugugcgacaucggcgagagcagccccaacccgaccaucgaggccggccgcacccuccggguccugaaccugguggagaacuggcucaacaacaacacccaguucugcaucaaggugcugaaccccuacaugcccuccgucaucgagaagauggagacccugcagcgcaaguacgggggcgcccucgugcggaacccgcugagccgcaacuccacgcacgagauguacugggugagcaacgccaccgggaacaucgucuccagcgugaacaugaucucccggaugcugaucaaccgcuucaccaugaagcacaagaaggcgaccuacgagcccgacguggaccugggcagcgggacgcggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagaccaagcagacgggcagcgccuccagcauggucaacgggguggugcgccugcugaccaagccgugggacgucgugcccauggugacccagauggccaugaccgacacgacccccuucggccagcagcgggucuucaaggagaagguggacacccgcacccaggagcccaaggagggcacgaagaagcucaugcggaucaccgccgaguggcuguggaaggagcuggggaagaagaagaccccgcgcaugugcacccgggaggaguucacgcgcaaggugcgguccaacgcggcccucggcgccaucuucaccgacgagaacaaguggaaguccgcccgcgaggccgucgaggacgggcgguucugggagcugguggaccgcgagcggaaccugcaccucgagggcaagugcgagaccugcgucuacaacaugauggggaagcgcgagaagaagcugggcgaguucggcaaggcgaaggggucccgggccaucugguacauguggcugggcgcccgcuuccucgaguucgaggcccugggguuccugaacgaggaccacugguucagccggggcaacucccucagcgggguggagggcgagggccugcaccgccugggguacauccuccgggacgugggcaagaaggagggcggcgcgauguacgccgacgacaccgccgggugggacacgcgcaucacccuggaggaccugaagaacgaggagauggucaccaaccacaugaagggcgagcacaagaagcucgccgaggccaucuucaagcugaccuaccagaacaagguggugcggguccagcgccccacgccccggggcaccgugauggacaucaucagccgccgcgaccagcggggguccggccagguggggaccuacggccugaacaccuucacgaacauggaggcgcagcucauccgccagauggagggcgaggggaucuucaagagcauccagcaccugaccgucaccgaggagaucgccgugcagaacuggcuggcccgggugggccgcgagcggcucucccgcauggccaucagcggggacgacugcgucgugaagcccaucgacgaccgguucgccuccgcgcugaccgcccugaacgacaugggcaaggugcgcaaggacauccagcagugggagccgagccggggguggaacgacuggacgcagguccccuucugcucccaccacuuccacgagcucgugaugaaggacggccgcgugcuggucgugcccugccggaaccaggacgagcugaucggccgcgcccggaucagccagggggccggcuggucccucaaggagaccgccugccugggcaagagcuacgcgcagauguggacccugauguacuuccaccgccgggaccuccgccuggccgccaacgccaucugcuccgccgugcccagccacugggucccgaccucccggaccacguggagcauccacgcgaagcacgaguggaugaccaccgaggacaugcuggccguguggaaccgcguguggauccaggagaaccccuggauggaggacaagacccccgucgaguccugggaggaggugcccuaccucggcaagcgggaggaccaguggugcgggagccugaucggccugacgucccgcgccaccugggccaagaacauccagaccgcgaucaaccaggugcgcagccucaucggcaacgaggaguacaccgacuacaugccgagcaugaagcgguuccgccgggaggaggaggaggccgggguccugugguga

SEQ ID NO: 9488 - RNA, 9876 nt, Artificial Sequence
  derived and/or modified CDS sequence (opt1) from DENV-2__JN819407__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccuccaccugggucaccuacgggaccugcaccaccacgggcgagcaccggcgcgagaagcgguccguggcccuggugccccacgucgggaugggccucgagacccggaccgagaccuggauguccuccgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagccugggcaaccuccuguucaccggccaccugaagugccgccuccggauggacaagcugcagcugaaggggaugagcuacuccaugugcaccggcaaguucaagaucgugaaggagaucgccgagacccagcacgggacgaucgugauccgcguccaguacgagggcgacggcagccccugcaagauccccuucgagaucaccgaccucgagaagcggcacgugcuggggcgccugaucaccgugaacccgaucgucaucgagaaggacucccccgugaacaucgaggcggagccgcccuucggcgacagcuacaucaucaucgggguggagccgggccagcucaagcugaacugguucaagaagggguccagcaucggccagauguucgagaccacgaugcgcggcgccaagcggauggccauccugggggacaccgccugggacuucggcucccucgggggcgucuucaccagcaucgggaaggcccugcaccagguguucggcgcgaucuacggcgccgccuucuccggggugagcuggaccaugaagauccugaucggcgucgugaucacguggaucgggaugaacucccgcagcaccucccugagcgugucccucguccuggugggcguggucacccuguaccucggggccauggugcaggcggacagcggcugcguggucuccuggaagaacaaggagcugaagugcggcagcgggaucuucaucaccgacaacgugcacacguggaccgagcaguacaaguuccagcccgagucccccagcaagcuggccagcgccauccagaaggcccacgaggagggcaucugcgggauccgguccgugacccgccucgagaaccugauguggaagcagaucacccccgagcugaaccacauccucagcgagaacgaggucaagcugacgaucaugaccggcgacaccaaggggaucaugcaggccggcaagcggucccugcgcccgcagcccaccgagcucaaguacagcuggaagacguggggcaaggcgaagaugcuguucaccgagucccacaaccagaccuuccugaucgacgggcccgagaccgccgagugcccgaacacgaaccgggccuggaacagccucgagguggaggacuacggcuucgggguguucuccaccaacaucuggcugaagcugcgcgagaagcaggacgucuucugcgacagcaagcucauguccgccgccaucaaggacaaccgggcggugcacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggcggggcccuggcaccugggcaagcuggagauggacuucgacuucugcgaggggaccaccguggucgugaccgaggacugcggcaaccggggccccucccuccgcacgaccaccgccagcgggaagcugaucaccgaguggugcugccggagcugcacgcugcccccgcuccgcuaccggggcgaggacgggugcugguacggcauggagauccgcccccugaaggagaaggaggagaaccuggugaacucccucgucaccgccgggcacggccagaucgacaacuucagccugggcgugcuggggauggcccucuuccuggaggagaugcugcggacccgcgugggcaccaagcacgcgauccuccuggucgccguguccuucgugacgcugaucaccgggaacaugagcuuccgggaccucggccgcgucauggugauggugggggccaccaugaccgacgacaucggcaugggcgucacguaccuggcccugcucgccgcguucaaggugcgccccaccuucgccgccgggcugcugcuccggaagcugaccuccaaggagcugaugauggccaccaucggcaucacgcuccugagccaguccaccauccccgagaccauccuggagcucaccgacgcccuggcgcuggggaugauggugcucaagaucguccgcaacauggagaaguaccagcuggccgugacgaucauggccaucagcugcgugccgaacgccgucauccugcggaacgccuggaagguguccugcaccauccucgcggccgucagcgugagcccccugcugcucaccagcucccagcagaaggccgacuggaucccccuggcccugaccaucaagggccucaaccccacggcgaucuuccugaccacccugagccgcaccuccaagaagcggagcuggccgcucaacgaggccaucauggccgugggcauggucuccauccuggccagcucccugcucaagaacgacauccccaugacggggccccugguggccggcgggcugcucaccgugugcuacguccugaccggccgcagcgcggaccuggagcucgagcgggccgccgacgugaagugggaggaccaggccgagaucagcggguccagccccauccuguccaucaccaucagcgaggacggcuccaugagcaucaagaacgaggaggaggagcagacgcugaccauccucauccgcaccggccugcuggugaucuccggggucuucccggugagcauccccaucaccgccgcggccugguaccucugggaggugaagaagcagcgggccggcguccugugggacgugcccagcccgccgcccguggggaaggccgagcuggaggacggcgccuaccgcaucaagcagcgggggauccucggcuacagccagaucggcgcgggggucuacaaggagggcaccuuccacacgauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcccuggagcccgggaagaacccccgggccguccagaccaagcccggcaucuucaagaccaacacggggaccaucggcgcggugucccucgacuucagccccggcaccuccgggagccccaucguggaccgcaagggcaaggucguggggcuguacggcaacggcguggucacccgguccggggccuacgugagcgccaucgcccagacggagaaguccaucgaggacaaccccgagaucgaggacgacaucuuccgcaagaagcggcugaccaucauggaccuccaccccggcgcggggaagaccaagcgcuaccugcccgccaucgugcgggaggccaucaagcgcggccugcgcacccugauccucgccccgacgcgggucguggccgcggagauggaggaggcccugcgcgggcugcccauccgguaccagacccccgccaucaaggccgagcacaccggccgcgagaucguggaccucaugugccacgccaccuucacgaugcggcugcugagccccguccgcgugccgaacuacaaccucaucaucauggacgaggcgcacuucaccgaccccgccagcaucgccgcccggggcuacaucuccacccgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagaccgugugguucgugccgagcaucaaggccggcaacgacaucgcggccugccugcgcaagaacggcaagaaggucauccagcugucccggaagaccuucgacagcgaguacgugaagacgcgcgccaacgacugggacuucguggucaccaccgacaucuccgagaugggggccaacuucaaggccgagcgggugaucgacccccgccggugcaugaagcccgugauccucaccgacggcgaggagcgcgucauccuggcggggcccaugccggugacgcacagcuccgccgcccagcggcgcggccgcaucgggcggaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgcgagaagguggacgcgaucgacggggaguaccggcugcgcggcgaggcccggaagaccuucgucgaccucaugcgccgcggggaccugcccguguggcuggccuacaagguggccgccgagggcaucaacuacgcggaccgcaaguggugcuucgacgggaucaagaacaaccagauccucgaggagaacgucgagguggagaucuggaccaaggagggcgagcggaagaagcugaagccgcgcuggcuggacgcccggaucuacuccgacccccucgcccugaaggaguucaaggaguucgccgcgggccgcaagagccugacgcucaaccugaucaccgagauggggcggcugcccaccuucaugacccagaaggcccgcaacgcccucgacaaccuggccguccugcacacggccgaggcgggcgggcgggccuacaaccacgcccucuccgagcugcccgagacccuggagacccuccugcugcucacccugcuggccacggugaccggcggcaucuuccucuuccugaugagcgggaagggcaucgggaagaugacccugggcaugugcugcaucaucaccgccuccgugcuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggguuccuggagaagaccaagaaggaccucggccugggcuccaucacgacccaggagccggagagcaacauccuggacaucgaccuccggcccgccagcgccuggacccuguacgccguggcgaccacguucgucacccccaugcugcgccacuccaucgagaacagcuccgugaacgugagccucaccgccaucgccaaccaggccaccguccugauggggcugggcaagggguggccccucuccaagauggacaucggcgugccgcugcuggcgaucgggugcuacagccaggugaaccccaucacgcucaccgccgcccugcugcuccuggucgcccacuacgccaucaucggccccggccugcaggcgaaggccacccgggaggcccagaagcgcgccgccgcggggaucaugaagaaccccaccguggacggcaucacggugaucgaccucgagccgauccccuacgaccccaaguucgagaagcagcuggggcaggucaugcugcucauccugugcgugacccaggugcugaugaugcggaccaccugggcccucugcgaggcccugacgcuggccaccggccccaucuccacccucugggaggggaacccgggccgcuucuggaacaccacgaucgccgucagcauggcgaacaucuuccgcggcuccuaccuggccggggccggccuccucuucagcaucaugaagaacaccaccaacacccggcgcgggacgggcaacaucggcgagacccugggggagaaguggaagucccggcugaacgcccucggcaagagcgaguuccagaucuacaagaaguccgggauccaggagguggaccgcacccuggcgaaggagggcaucaagcgcggggagaccgaccaccacgccgugagccgcggcuccgccaagcugcggugguucgucgagcgcaacauggugacgcccgagggcaagguggucgaccucgggugcggccgcggcggguggagcuacuacugcggcgggcugaagaacgugcgcgaggugaaggggcugaccaagggcgggcccgggcacgaggagcccaucccgauguccaccuacggcuggaaccucguccggcugcagagcgggguggacguguucuucacgccgcccgagaagugcgacacgcugcucugcgacaucggcgaguccagccccaacccgaccaucgaggccggccgcacccugcggguccugaaccucguggagaacuggcugaacaacaacacccaguucugcaucaaggugcugaaccccuacaugcccagcgucaucgagaagauggagacccuccagcgcaaguacgggggcgcccuggugcggaacccgcugucccgcaacagcacgcacgagauguacuggguguccaacgcgaccgggaacaucgucagcuccgugaacaugaucagccggaugcugaucaaccgcuucaccaugaagcacaagaaggccaccuacgagcccgacguggaccucggcuccgggacgcggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgccagcuccauggucaacgggguggugcgccugcucaccaagccgugggacgucgugcccauggugacccagauggccaugaccgacacgacccccuucggccagcagcgggucuucaaggagaagguggacacccgcacccaggagcccaaggagggcacgaagaagcugaugcggaucaccgcggaguggcuguggaaggagcucgggaagaagaagaccccgcgcaugugcacccgggaggaguucacgcgcaaggugcggagcaacgccgcccugggcgccaucuucaccgacgagaacaaguggaaguccgcccgcgaggcggucgaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggccaucugguacauguggcucggcgcccgcuuccuggaguucgaggcgcugggguuccucaacgaggaccacugguucucccggggcaacagccuguccgggguggagggcgagggccugcaccgccucggguacauccugcgggacgugggcaagaaggagggcggcgccauguacgccgacgacaccgccgggugggacacgcgcaucacccuggaggaccucaagaacgaggagauggucaccaaccacaugaagggcgagcacaagaagcuggccgaggcgaucuucaagcugaccuaccagaacaagguggugcggguccagcgccccacgccccggggcaccgugauggacaucaucagccgccgcgaccagcgggggagcggccagguggggaccuacggccucaacaccuucacgaacauggaggcccagcugauccgccagauggagggcgaggggaucuucaaguccauccagcaccugaccgucaccgaggagaucgccgugcagaacuggcucgcccgggugggccgcgagcggcugagccgcauggccaucuccggggacgacugcgucgugaagcccaucgacgaccgguucgcgagcgcccugaccgcccucaacgacaugggcaaggugcgcaaggacauccagcagugggagccgucccggggguggaacgacuggacgcagguccccuucugcagccaccacuuccacgagcuggugaugaaggacggccgcgugcuggucgugcccugccggaaccaggacgagcucaucggccgcgcccggaucucccagggggccggcuggagccugaaggagaccgcgugccuggggaaguccuacgcccagauguggacccucauguacuuccaccgccgggaccugcgccuggccgccaacgccaucugcagcgcggugcccucccacugggucccgaccagccggaccacgugguccauccacgccaagcacgaguggaugaccaccgaggacaugcucgccguguggaaccgcguguggauccaggagaaccccuggauggaggacaagacccccgucgagagcugggaggaggugcccuaccugggcaagcgggaggaccaguggugcgggucccugaucggccucacgagccgcgccaccugggcgaagaacauccagaccgccaucaaccaggugcgcucccugaucggcaacgaggaguacaccgacuacaugccgagcaugaagcgguuccgccgggaggaggaggaggccgggguccugugguga

SEQ ID NO: 9489 - RNA, 9876 nt, Artificial Sequence
  derived and/or modified CDS sequence (opt1) from DENV-2__FJ898465__SS-prME
accgcgggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucgccaucauggcggccauccuggccuacaccaucgggaccacccacuuccagaaggcccucaucuucauccugcugaccgcgguggcccccagcaugaccaugcggugcaucggcaucuccaaccgcgacuucguggagggcgucagcgggggcuccuggguggacaucgugcucgagcacgggagcugcgucaccaccauggccaagaacaagcccacccuggacuucgagcugaucaagaccgaggccaagcagcccgccacccuccggaaguacugcaucgaggcgaagcugaccaacacgaccaccgagucccgcugcccgacccagggcgagcccagccugaacgaggagcaggacaagcgguucaucugcaagcacuccaugguggaccgcggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccgccagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccggcuccgcauggacaagcugcagcugaaggggauguccuacagcaugugcaccggcaaguucaagaucgucaaggagaucgcggagacccagcacgggaccaucgugauccgggugcaguacgagggcgacggcucccccugcaagauccccuucgagaucauggaccucgagaagcgccacguccuggggcggcugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcgcauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgguccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccgcagcgucacccggcucgagaaccugauguggaagcagaucacccccgagcugaaccacauccucuccgagaacgaggugaagcugaccaucaugacgggcgacaucaaggggaucaugcaggcgggcaagcgcagccugcggccgcagcccaccgagcucaaguacuccuggaagaccuggggcaaggccaagaugcugagcaccgagucccacaaccagacguuccugaucgacgggcccgagaccgccgagugcccgaacaccaaccgcgccuggaacagccucgagguggaggacuacggcuucggggucuucuccaccaacaucuggcugaagcugcgggagaagcaggacguguucugcgacagcaagcucauguccgccgcgaucaaggacaaccgcgccgugcacgccgacaugggcuacuggaucgagagcgcccugaacgacacguggaagauggagaaggccuccuucaucgaggucaagagcugccacuggcccaagucccacacccuguggagcaacggcgugcucgaguccgagaugaucauccccaagaacuucgcggggcccgugagccagcacaacuaccggccgggcuaccacacccagaccgccgggcccuggcaccugggcaagcuggagauggacuucgacuucugcgaggggaccacggucguggugaccgaggacugcggcaaccgcggccccagccuccggaccaccacggccuccgggaagcugaucaccgaguggugcugccgcagcugcacccugcccccgcuccgguaccgcggcgaggacgggugcugguacggcauggagauccggccccugaaggagaaggaggagaaccuggucaacucccucgugaccgccgggcacggccagaucgacaacuucagccugggcgugcuggggauggcccucuuccuggaggagaugcugcgcacgcgggucggcaccaagcacgccaugcuccugguggccguguccuucgucacccugaucaccgggaacaugagcuuccgcgaccucggccgggugauggugauggucggggccacgaugaccgacgacaucggcaugggcgugaccuaccuggcccugcucgcggccuucaaggugcgccccaccuucgccgccgggcugcugcuccgcaagcugacguccaaggagcugaugauggccaccaucggcaucgcgcuccugagccaguccaccauccccgagaccauccuggagcucacggacgcccuggcccuggggaugaugguccucaagaucgugcggaacauggagaacuaccagcuggccgugaccaucauggccaucagcugcgucccgaacgcggugauccugcucaacgccuggaagguguccugcaccauccuggccgccgucagcgugagcccccugcuccugaccagcucccagcagaaggcggacuggaucccccuggcccucacgaucaagggccugaaccccaccgccaucuuccugaccacccucagccgcacguccaagaagcggagcuggccgcugaacgaggccgucauggccgugggcaugguguccauccuggcgagcagccuccugaagaacgacauccccaugaccgggccccuggucgccggcgggcuccugaccgugugcuacgugcugaccggccgcuccgccgaccucgagcuggagcgggccgccgacgucaagugggaggaccacgcggagaucagcggguccagccccauccuguccaucacgaucagcgaggacggcuccaugagcaucaagaacgaggaggaggagcagacccucaccauccugauccgcaccggccugcucgugaucuccgggguguucccggucagcauccccaucacggccgccgccugguaccugugggaggugaagaagcagcgggccggcgugcugugggacguccccagcccgccgcccguggggaaggcggagcucgaggacggcgccuaccgcaucaagcagcgggggauccugggcuacagccagaucggcgccgggguguacaaggagggcaccuuccacaccauguggcacgucacccgcggggccgugcugaugcaccggggcaagcgcaucgagcccuccugggccgacgugaagaaggaccucaucagcuacgggggcggcuggaagcuggagggggaguggaaggagggcgaggagguccaggugcuggcgcucgagcccgggaagaacccccgggccgugcagaccaagcccggccuguucaagacgaacaccgggaccaucggcgccgucucccuggacuucagccccggcaccuccgggagccccaucguggaccgcaagggcaagguggucgggcucuacggcaacggcguggugacgcgguccggggccuacgucagcgcgaucgcccagaccgagaaguccaucgaggacaaccccgagaucgaggacgacaucuuccgcaagaagcggcugaccaucauggaccugcaccccggcgccgggaagaccaagcgcuaccugcccgccaucgugcgggaggccaucaagcgcggccuccggacgcugauccuggcgccgacccgcguggucgccgccgagauggaggaggcccuccgcgggcugcccauccgguaccagacccccgccauccgcgcggagcacaccggccgggagaucguggaccugaugugccacgccacguucaccaugcgccuccugucccccgugcgggucccgaacuacaaccugaucaucauggacgaggcccacuucaccgaccccgccagcaucgccgcgcgcggcuacaucuccacccggguggagaugggggaggccgccggcaucuucaugacggccacgccgcccgggagccgcgacccguucccccaguccaacgcgcccaucauggacgaggagcgggagauccccgagcgcagcuggaacuccggccacgagugggugaccgacuucaaggggaagaccgucugguucgugccgagcaucaaggccggcaacgacaucgccgccugccuccggaagaacggcaagaaggugauccagcugucccgcaagacguucgacagcgaguacgucaagacccgggccaacgacugggacuucguggugaccaccgacaucuccgagaugggggcgaacuuccgcgccgagcgggucaucgacccccgccggugcaugaagcccgugauccugacggacggcgaggagcgcgugauccucgccgggcccaugccggucacccacagcuccgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccgagcauguucgagcccgagcgcgagaagguggacgccaucgacggggaguaccggcugcgcggcgaggcccggaagaccuucguggaccugaugcgccgcggggaccuccccgucuggcuggccuaccgcguggcggccgagggcaucaacuacgccgaccggcgcuggugcuucgacgggaucaagaacaaccagauccuggaggagaacguggaggucgagaucuggacgaaggagggcgagcggaagaagcucaagccgcgcuggcuggacgcccggaucuacuccgacccccuggcgcucaaggaguucaaggaguucgccgccggccgcaagagccugacccugaaccucaucaccgagauggggcggcugcccaccuucaugacgcagaaggcccgcgacgcccuggacaaccucgcggugcugcacaccgccgaggccggcgggcgggccuacaaccacgcccuguccgagcuccccgagacccuggagacccugcuccugcugacgcuccuggcgaccgucaccggcggcaucuuccuguuccucaugagcgggaagggcaucgggaagaugacccugggcaugugcugcaucaucacggccuccauccugcucugguacgcccagauccagccgcacuggaucgccgccagcaucauccuggaguucuuccugaucgugcuccugauccccgagcccgagaagcagcgcacgccccaggacaaccagcugaccuacguggucaucgcgauccucaccgugguggccgccaccauggccaacgagaugggguuccuggagaagacgaagaaggaccugggccucggcagcaucaccacccaggaguccgagagcaacauccuggacaucgaccugcggccggccuccgcguggacccucuacgccgucgccacgaccuucgugacccccaugcugcgccacagcaucgagaacuccagcgugaacgucucccugaccgccaucgcgaaccaggccacggugcucauggggcugggcaagggguggccccugagcaagauggacaucggcgugccccuccuggccaucgggugcuacucccaggucaacccgaucacccugaccgccgcccuccugcugcucguggcgcacuacgccaucaucggccccggccugcaggccaaggccacccgggaggcccagaagcgcgcggccgccgggaucaugaagaaccccacgguggacggcaucaccgucaucgaccuggagcccaucccguacgaccccaaguucgagaagcagcucggccaggugaugcugcugauccucugcgugacccagguccugaugaugcgcaccacgugggcccugugcgaggcccucacccuggcgaccggccccaucagcacccugugggaggggaaccccggccgguucuggaacacgaccaucgccguguccauggccaacaucuuccgcggcagcuaccucgccggggcgggccugcuguucuccaucaugaagaacaccaccaacacgcggcgcgggaccggcaacaucggcgagacccucggggagaaguggaagucccggcugaacgcccugggcaaguccgaguuccagaucuacaagaaguccgggauccaggagguggaccgcacccucgccaaggagggcaucaagcgcggggagacggaccaccacgccgucucccgcggcagcgccaagcugcggugguucguggagcgcaacauggugaccccggagggcaaggucguggaccuggggugcggccgcggcgggugguccuacuacugcggcgggcucaagaacgugcgcgaggucaaggggcugaccaagggcgggcccgggcacgaggagcccauccccaugagcaccuacggcuggaaccuggugcggcuccagagcgggguggacgucuucuucacgccgcccgagaagugcgacacccugcugugcgacaucggcgaguccagccccaaccccaccaucgaggcgggccgcacccuccgggugcugaaccugguggagaacuggcucaacaacaacacgcaguucugcaucaagguccugaacccguacaugcccuccgugaucgagaagauggagacccugcagcgcaaguacgggggcgcccuggugcggaacccccucagccgcaacuccacccacgagauguacugggucagcaacgccaccgggaacaucguguccagcgugaacaugaucucccggaugcugaucaaccgcuucaccaugaagcacaagaaggccacguacgagccggacgucgaccugggcagcgggacccgcaacaucggcaucgaguccgagauccccaaccucgacaucaucggcaagcggaucgagaagaucaagcaggagcacgagaccagcuggcacuacgaccaggaccaccccuacaagaccugggccuaccacggguccuacgagacgaagcagaccggcagcgcguccagcauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaagguccgguccaacgccgcccucggcgcgaucuucaccgacgagaacaaguggaaguccgcccgcgaggccguggaggacucccgguucugggagcugguggaccgcgagcggaaccugcaccucgaggggaagugcgagaccugcgucuacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucagccgggggaacucccucagcggcguggagggggagggccugcaccgccugggcuacauccuccgggacgucuccaagaaggagggcggggccauguacgccgacgacacggcggggugggacacccgcaucacccuggaggaccugaagaacgaggagauggugaccaaccacaugaagggcgagcacaagaagcucgccgaggccaucuucaagcugacguaccagaacaaggugguccgggugcagcgcccgacgccccgggggaccgugauggacaucaucagccggcgcgaccagcggggcuccggccaggucgggaccuacggccugaacacguucaccaacauggaggcccagcucauccgccagauggagggggagggcaucuucaagagcauccagcaccugaccgugaccgaggagaucgccgugcagaacuggcuggcgcgggucggccgcgagcggcucucccgcauggccaucagcggggacgacugcguggugaagccccuggacgaccgguucgccuccgcccugacggcccucaacgacaugggcaagguccgcaaggacauccagcagugggagcccagccggggguggaacgacuggacccaggugccguucugcucccaccacuuccacgagcuggugaugaaggacggccgcguccugguggugcccugccggaaccaggacgagcucaucgggcgcgcgcggaucagccagggcgccggcuggucccugaaggagaccgccugccugggcaagagcuacgcccagauguggacccucauguacuuccaccgccgggaccugcgccuggccgcgaacgccaucugcuccgccguccccagccacugggugcccacgucccggaccaccuggagcauccacgccaagcacgaguggaugaccaccgaggacaugcucgcgguguggaaccgcgucuggauccaggagaacccguggauggaggacaagacgcccguggagagcugggaggaggugcccuaccugggcaagcgcgaggaccaguggugcgggucccugaucggccucaccagccgggccaccugggccaagaacauccagaccgccaucaaccagguccgcucccugaucgggaacgaggaguacacggacuacaugcccagcaugaagcgguuccgccgggaggaggaggaggccggcgugcugugguga

SEQ ID NO: 9490 - RNA, 9876 nt, Artificial Sequence
  derived and/or modified CDS sequence (opt1) from DENV-2__FJ898466__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagcgggcccacgaggagggcaucugcgggauccgcagcgugacccggcuggagaaccucauguggaagcagaucacgcccgagcugaaccacauccuguccgagaacgaggugaagcucaccaucaugaccggcgacaccaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggaggucgaggacuacggcuucgggguguucaccaccaacaucuggcucaagcugcgggagaagcaggacaucuucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccggccgggcuaccacacccagaccgcggggcccuggcaccucggcaagcuggagauggacuucgacuucugcgaggggaccacggucguggugaccgaggacugcggcaaccgcggccccagccugcggaccaccacggccagcgggaagcucaucaccgaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacgcgggucggcaccaagcacgcgauccugcucguggccgugagcuucgucacccugaucaccgggaacauguccuuccgcgaccugggccgcgugauggugauggucggggccacgaugaccgacgacaucggcaugggcgugaccuaccucgcccugcuggccgcguucaaggugcggcccaccuucgccgccgggcuccugcugcgcaagcucacgagcaaggagcugaugauggccaccaucggcaucgcccugcucucccagagcaccauccccgagaccauccuggagcugacggacgcgcucgcccuggggaugauggcccugaagaucguccggaacauggagaaguaccagcucgccgugaccaucauggccaucuccugcgugccgaacgcggucauccugcagaacgccuggaaggugagcugcaccauccuggccgccguguccgucagcccccuccugcugaccuccagccagcagaaggcggacuggaucccccucgcccugacgaucaagggccugaaccccaccgccaucuuccucaccacccugucccgcacgagcaagaagcgguccuggccgcugaacgaggccaucauggccgugggcauggucagcauccucgcguccagccugcugaagaacgacauccccaugaccgggccccucguggccggcgggcugcugaccgugugcuacguccucaccggccgcagcgccgaccuggagcuggagcgggccgccgacgugaagugggaggaccaggcggagaucuccgggagcucccccauccucagcaucacgaucuccgaggacggcagcauguccaucaagaacgaggaggaggagcagacccugaccauccugauccgcaccggccuccuggugaucagcggggucuucccgguguccauccccaucaccgccgccgccugguaccugugggaggugaagaagcagcgggccggcguccucugggacgugcccagcccgccgcccguggggaaggcggagcuggaggacggcgccuaccgcaucaagcagcgggggauccugggcuacucccagaucggcgccggggucuacaaggagggcacguuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcgcuggagcccgggaagaacccccgggccguccagaccaagcccggcaucuuccgcacgaacaccgggaccaucggcgccgugagccuggacuucucccccggcaccagcgggucccccaucguggaccggaagggcaaggucguggggcucuacggcaacggcguggucacgcgcagcggggccuacguguccgcgaucgcccagaccgagaaguccaucgaggacaaccccgagaucgaggacgacaucuuccggaagaagcgccugaccaucauggaccugcaccccggcgccgggaagaccaagcgguaccuccccgccaucgugcgcgaggccaucaagcgcggccugcggacgcugauccuggcgccgacccgcgucguggccgccgagauggaggaggcccuccgggggcugcccauccgcuaccagacccccgccaucaaggcggagcacaccggccgggagaucguggaccugaugugccacgccacguucaccaugcgccuccugagccccguccgggugccgaacuacaaccugaucaucauggacgaggcccacuucaccgaccccgccuccaucgccgcgcgcggcuacaucagcacccggguggagaugggggaggccgccggcaucuucaugacggccacgccgcccgggucccgcgacccguucccccagagcaacgcgcccaucauggacgaggagcgggagauccccgagcgcuccuggaacagcggccacgagugggucaccgacuucaaggggaagaccgugugguucgugccguccaucaaggccggcaacgacaucgccgccugccuccggaagaacggcaagaaggucauccagcugagccgcaagacguucgacuccgaguacgugaagacccgggccaacgacugggacuucguggucaccaccgacaucagcgagaugggggcgaacuucaaggccgagcgcgugaucgacccccggcgcugcaugaagcccgugauccugacggacggcgaggagcgggucauccucgccgggcccaugccggugacccacuccagcgccgcccagcgccgcggccggaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaagguggacgccaucgacggggaguaccgccugcggggcgaggcccgcaagaccuucgucgaccugaugcggcgcggggaccuccccguguggcuggccuacaagguggcggccgagggcaucaacuacgccgaccggaaguggugcuucgacgggaucaagaacaaccagauccuggaggagaacgucgagguggagaucuggacgaaggagggcgagcgcaagaagcucaagccgcgguggcuggacgcccgcaucuacagcgacccccuggcgcucaaggaguucaaggaguucgccgccggccggaagucccugacccugaaccucaucaccgagauggggcgccugcccaccuucaugacgcagaaggcccggaacgcccuggacaaccucgcggugcugcacaccgccgaggccggcgggcgcgccuacaaccacgcccugagcgagcuccccgagacccuggagacccugcuccugcugacgcuccuggcgaccgucaccggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucaccguggucgccgccaccauggccaacgagaugggguuccuggagaagacgaagaaggaccugggccucggcagcaucaccacccaggagagcgaguccaacauccuggacaucgaccugcgcccggccagcgcguggacccucuacgccguggccacgaccuucaucacccccaugcugcggcacuccaucgagaacagcuccgugaacgucagccugaccgccaucgcgaaccaggccacggugcucauggggcugggcaagggguggccccuguccaagauggacaucggcgugccccuccuggccaucgggugcuacagccaggucaacccgaucacccugaccgccgcccuccugcugcucguggcgcacuacgccaucaucggccccggccugcaggccaaggccacccgcgaggcccagaagcgggcggccgccgggaucaugaagaaccccacgguggacggcaucaccgucaucgaccuggagcccaucccguacgaccccaaguucgagaagcagcucggccaggugaugcugcugauccucugcgugacccagguccugaugaugcgcaccacgugggcccugugcgaggcccucacccuggcgaccggccccaucuccacccugugggaggggaaccccggccgcuucuggaacacgaccaucgccgugagcauggccaacaucuuccggggcuccuaccucgccggggcgggccugcuguucagcaucaugaagaacaccaccaacacgcgccgggggaccggcaacaucggcgagacccucggggagaaguggaagucccgccugaacgcccugggcaagagcgaguuccagaucuacaagaaguccgggauccaggagguggaccggacccucgccaaggagggcaucaagcgcggggagacggaccaccacgccgucagccggggcuccgccaagcugcgcugguucguggagcggaacauggugaccccggagggcaaggucguggaccuggggugcggccgcgggggcuggagcuacuacugcgggggccucaagaacgugcgggaggucaagggccugaccaagggcgggcccgggcacgaggagcccauccccauguccaccuacggcuggaaccuggugcgccuccagagcgggguggacgucuucuucacgccgcccgagaagugcgacacccugcugugcgacaucggcgagagcucccccaaccccaccaucgaggcgggccggacccuccgcgugcugaaccugguggagaacuggcucaacaacaacacccaguucugcaucaagguccugaacccguacaugcccagcgugaucgagaagauggagacgcugcagcggaaguacgggggcgcccucgugcgcaacccccugucccggaacagcacccacgagauguacugggucuccaacgccaccgggaacaucgugagcuccgugaacaugaucagccgcaugcugaucaaccgguucaccaugaagcacaagaaggccacguacgagccggacgucgaccugggcuccgggacccgcaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgcgagcuccauggugaacggggugguccggcugcugaccaagcccugggacguggugccgauggucacccagauggccaugacggacaccacccccuucggccagcagcgcguguucaaggagaagguggacacccggacgcaggagcccaaggagggcaccaagaagcucaugaagaucaccgccgaguggcuguggaaggagcuggggaagcgcaagacgccccggaugugcacgcgcgaggaguucaccaagaagguccggagcaacgccgcccucggcgcgaucuucaccgacgagaacaaguggaaguccgcccgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcgggguggagggcgagggccugcaccgccugggguacauccuccgggacgugggcaagaaggagggcggggccauguacgccgacgacacggcggggugggacacccgcaucacccuggaggaccugaagaacgaggagauggucaccaaccacaugaagggcgagcacaagaagcucgccgaggccaucuucaagcugacguaccagaacaaggugguccgggugcagcgcccgacgccccggggcaccgugauggacaucaucucccgccgcgaccagcgggggagcggccaggucgggaccuacggccugaacacguucaccaacauggaggcccagcucauccgccagauggagggcgaggggaucuucaaguccauccagcaccugaccgccaccgaggagaucgcggugcagaacuggcuggcccgggugggccgcgagcggcucagccgcauggccaucuccggggacgacugcgucgugaagcccaucgacgaccgguucgccagcgcccugacggcgcugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggucccaggacgagcugaucggccgcgcccggaucagccagggggccggcuggucccucaaggagaccgccugccugggcaagagcuacgcccagauguggacccugauguacuuccaccgccgggaccuccgccuggcggccaacgccaucugcuccgccgugcccagccacuggguccccaccucccggacgaccuggagcauccacgcgaagcacgaguggaugaccaccgaggacaugcuggccguguggaaccgcguguggauccaggagaacccguggauggaggacaagacgcccgucgaguccugggaggaggugcccuaccucggcaagcgggaggaccaguggugcgggagccugaucggccugaccagccgcgccaccugggccaagaacauccagaccgccaucaaccaggugcgcucccucaucggcaacgaggaguacacggacuacaugcccagcaugaagcgguuccgccgggaggaggaggaggcggggguccugugguga

SEQ ID NO: 9491 - RNA, 9876 nt, Artificial Sequence
  derived and/or modified CDS sequence (opt1) from DENV-2__FJ898467__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggaaggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcggacgccccaggacaaccagcugaccuacguggucaucgccauccucaccgugguggccgcgaccauggccaacgagaugggguuccuggagaagacgaagaaggaccugggccucggcagcaucaccacccaggagagcgaguccaacauccuggacaucgaccugcgcccggccagcgccuggacccucuacgccgucgcgacgaccuucgugacccccaugcugcggcacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccgcccuccugcugcucguggcccacuacgccaucaucggccccggccugcaggcgaaggccacccgcgaggcccagaagcgggccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcgcaccacgugggcccugugcgaggcccucacccuggccaccggccccaucuccacccugugggaggggaaccccggccgguucuggaacacgaccaucgccgugagcauggcgaacaucuuccgcggcuccuaccucgccggggccggccugcuguucagcaucaugaagaacaccaccaacacgcgccgggggaccggcaacaucggcgagacccucggggagaaguggaagucccgccugaacgcccugggcaagagcgaguuccagaucuacaagaaguccgggauccaggagguggaccggacccucgcgaaggagggcaucaagcgcggggagacggaccaccacgccgucagccggggcuccgccaagcugcgcugguucguggagcggaacauggugaccccggagggcaaggucguggaccuggggugcggccgcgggggcuggagcuacuacugcgggggccucaagaacgugcgggaggucaagggccugaccaagggcgggcccgggcacgaggagcccauccccauguccaccuacggcuggaaccuggugcgccuccagagcgggguggacgucuucuucacgccgcccgagaagugcgacacccugcugugcgacaucggcgagagcucccccaaccccaccaucgaggccggccggacccuccgcgugcugaaccugguggagaacuggcucaacaacaacacccaguucugcaucaagguccugaacccguacaugcccagcgugaucgagaagauggagacgcugcagcggaaguacgggggcgcccucgugcgcaacccccugucccggaacagcacccacgagauguacugggucuccaacgcgaccgggaacaucgugagcuccgugaacaugaucagccgcaugcugaucaaccgguucaccaugaagcacaagaaggccacguacgagccggacgucgaccugggcuccgggacccgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcgcguguucaaggagaagguggacacccggacgcaggagcccaaggagggcaccaagaagcucaugcgcaucaccgcggaguggcuguggaaggagcuggggaagaagaagacgccccggaugugcacgcgcgaggaguucacccggaagguccgcagcaacgccgcccucggcgccaucuucaccgacgagaacaaguggaaguccgcccgggaggcgguggaggacgggcgcuucugggagcugguggacaaggagcggaaccugcaccucgagggcaagugcgagaccugcgucuacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccggggcaacagccucagcgggguggagggcgagggccugcaccgccugggguacauccuccgggacgucggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggugguccgggugcagcgcccgacgccccggggcaccgugauggacaucaucucccgccgggaccagcgcgggagcggccaggucgggaccuacggccugaacacguucaccaacauggaggcccagcucauccgccagauggagggcgaggggaucuucaaguccauccagcaccugaccgccaccgaggagaucgccgugcagaacuggcuggcccgggugggccgcgagcggcucagccgcauggcgaucuccggggacgacugcgucgugaagcccaucgacgaccgguucgccagcgcccugacggcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucggccgcgcccggaucucccagggggcgggcuggagccucaaggagaccgccugccuggggaaguccuacgcccagauguggacccugauguacuuccaccgccgggaccuccgccuggccgccaacgcgaucugcagcgccgugcccucccacuggguccccaccagccggacgaccugguccauccacgccaagcacgaguggaugaccaccgaggacaugcuggccguguggaaccgcguguggauccaggagaacccguggauggaggacaagacgcccgucgagagcugggaggaggugcccuaccucggcaagcgggaggaccaguggugcgggucccugaucggccugaccagccgcgcgaccugggccaagaacauccagaccgccaucaaccaggugcggagccucaucggcaacgaggaguacacggacuacaugcccuccaugaagcgcuuccgccgggaggaggaggaggccgggguccugugguga

SEQ ID NO: 9492 - RNA, 9876 nt, Artificial Sequence
  derived and/or modified CDS sequence (opt1) from DENV-2__GQ868595__SS-prME
accgcgggcgugaucaucaugcugauccccaccgccauggcguuccaccucaccacccggaacggggagccccacaugaucgucagccggcaggagaagggcaagagccugcuguucaagaccgaggacggggugaacaugugcacccucauggccaucgaccugggcgagcugugcgaggacaccaucaccuacaagugcccccuccugcgccagaacgagcccgaggacaucgacugcuggugcaacagcaccagcaccugggugaccuacgggaccugcaccaccaccggcgagcaccggcgcgagaagcggagcgucgcccuggugccccacgugggcauggggcucgagacccgcaccgagaccuggaugagcagcgagggcgccuggaagcacguccagcggaucgagaccuggauccugcgccacccgggguucgccaucauggcggccauccuggccuacaccaucggcaccacccacuuccagcgggcccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgagagccggugcccgacccagggggagcccucccugaacgaggagcaggacaagcgcuucaucugcaagcacagcaugguggaccggggcuggggcaacgggugcggccucuucgggaagggcgggaucgugacgugcgccauguucacgugcaagaagaacauggagggcaaggucgugcugcccgagaaccuggaguacaccaucgugaucacgccccacuccggcgaggagcacgccgucgggaacgacacgggcaagcacgggaaggagaucaagaucaccccgcagagcuccaucaccgaggccgagcucaccggcuacgggaccgugacgauggagugcagcccccgcaccggccuggacuucaacgagauggugcugcuccagauggaggagaaggccuggcugguccaccggcagugguuccuggaccucccccugcccuggcugccgggcgcggacacccagggguccaacuggauccagaaggagacccucgugacguucaagaacccccacgccaagaagcaggacguggucgugcugggcagccaggagggggccaugcacaccgcccugaccggcgccaccgagauccagaugagcuccgggaaccuccuguucacgggccaccugaagugccgccuccggauggacaagcugcagcugaagggcaugagcuacuccaugugcaccgggaaguucaagaucgucaaggagaucgcggagacccagcacggcaccaucgugauccgcgugcaguacgagggggacggcagccccugcaagauccccuucgagaucauggaccucgagaagcggcacguccugggccgccugaucacggugaacccgaucgugaccgagaaggacucccccgucaacaucgaggccgagccgcccuucggggacagcuacaucaucaucggcguggagccggggcagcucaagcugaacugguucaagaagggcuccagcaucgggcagauguucgagaccaccaugcgcggcgccaagcggauggccauccugggcgacacggccugggacuucgggucccucggcgggguguucaccagcaucggcaaggcgcugcaccaggucuucggggccaucuacggcgccgccuucuccggcgugagcuggaccaugaagauccugaucggggugaucaucaccuggaucggcaugaacucccgcagcacgucccugagcgucucccucgugcuggugggggucgugacccuguaccucggcgcgauggugcaggccgacagcgggugcgucguguccuggaagaacaaggagcugaagugcggcagcggcaucuucaucaccgacaacgugcacaccuggacggagcaguacaaguuccagcccgagagccccuccaagcuggccagcgccauccagaaggcccacgaggaggggaucugcggcauccgguccgucacccgccucgagaaccugauguggaagcagaucacccccgagcugaaccacauccucagcgagaacgaggugaagcugaccaucaugacgggggacaucaagggcaucaugcaggcggggaagcggucccugcgcccgcagcccaccgagcucaaguacagcuggaagaccuggggcaaggccaagaugcuguccaccgagagccacaaccagacguuccugaucgacggccccgagaccgccgagugcccgaacaccaaccgggccuggaacucccucgagguggaggacuacggguucggcgucuucaccacgaacaucuggcugaagcugcgcgagaagcaggacguguucugcgacagcaagcucauguccgccgcgaucaaggacaaccgggccgugcacgccgacaugggguacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcgggccccgugagccagcacaacuaccgcccgggguaccacacccagaccgccggccccuggcaccuggggaagcuggagauggacuucgacuucugcgagggcacgaccgucguggugaccgaggacugcgggaaccggggccccagccuccgcaccacgaccgccuccggcaagcugaucaccgaguggugcugccggagcugcacccugcccccgcuccgcuaccgcggggaggacggcugcugguacgggauggagauccgcccccugaaggagaaggaggagaaccuggucaacucccucgugacggccggccacgggcagaucgacaacuucagccugggcgugcugggcauggcccucuuccuggaggagaugcugcggacccgcgucgggaccaagcacgccauccuccugguggccguguccuucgucacccugaucacgggcaacaugagcuuccgggaccucgggcgcgugauggugauggucggcgccaccaugaccgacgacaucgggaugggcgugaccuaccuggcccugcucgcggccuucaaggugcgccccacguucgccgccggccugcugcuccggaagcugaccuccaaggagcugaugauggccaccaucgggaucgcgcuccugagccaguccaccauccccgagacgauccuggagcucaccgacgcccuggcccugggcaugaugguccucaagaucgugcgcaacauggagaaguaccagcuggccgugaccaucauggccaucagcugcgucccgaacgcggugauccugcucaacgccuggaagguguccugcaccauccuggccgccgucagcgugagcccccugcuccugacgagcucccagcagaaggcggacuggaucccccuggcccucaccaucaaggggcugaaccccaccgccaucuuccugaccacgcucagccggaccuccaagaagcgcagcuggccgcugaacgaggccgucauggccgugggcaugguguccauccuggcgagcagccuccugaagaacgacauccccaugaccggcccccuggucgccgggggccuccugaccgugugcuacgugcugacggggcgguccgccgaccucgagcuggagcgcgccgccgacgucaagugggaggaccaggcggagaucagcggcuccagccccauccuguccaucaccaucagcgaggacggguccaugagcaucaagaacgaggaggaggagcagacccucaccauccugauccggacgggccugcucgugaucuccggcguguucccggucagcauccccaucaccgccgccgccugguaccugugggaggugaagaagcagcgcgccggggugcugugggacguccccagcccgccgcccgugggcaaggcggagcucgaggacggggccuaccggaucaagcagcgcggcauccugggguacagccagaucggcgccggcguguacaaggaggggaccuuccacaccauguggcacgucacccggggcgccgugcugaugcaccgcgggaagcggaucgagcccuccugggccgacgugaagaaggaccucaucagcuacggcgggggcuggaagcuggagggcgaguggaaggagggggaggagguccaggugcuggcgcucgagcccggcaagaacccccgcgccgugcagacgaagcccgggcuguucaagaccaacaccggcaccaucggggccgucucccuggacuucagccccggcacguccggcagccccaucguggaccggaaggggaagguggucggccucuacgggaacggcguggugacccgcuccggcgccuacgucagcgcgaucgcccagaccgagaaguccaucgaggacaaccccgagaucgaggacgacaucuuccggaagaagcgccugaccaucauggaccugcaccccggggccggcaagacgaagcgguaccugcccgccaucgugcgcgaggccaucaagcgggggcuccgcacccugauccuggcgccgacccgcguggucgccgccgagauggaggaggcccuccggggccugcccauccgcuaccagacccccgccauccgggcggagcacacggggcgcgagaucguggaccugaugugccacgccaccuucaccaugcggcuccugucccccgugcgcgucccgaacuacaaccugaucaucauggacgaggcccacuucaccgaccccgccagcaucgccgcgcggggcuacaucuccacgcgcguggagaugggcgaggccgccgggaucuucaugaccgccacgccgcccggcagccgggacccguucccccaguccaacgcgcccaucauggacgaggagcgcgagauccccgagcggagcuggaacuccgggcacgagugggugaccgacuucaagggcaagacggucugguucgugccgagcaucaaggccgggaacgacaucgccgccugccuccgcaagaacggcaagaaggugauccagcugucccggaagaccuucgacagcgaguacgucaagacccgcgccaacgacugggacuucguggugaccacggacaucuccgagaugggcgcgaacuuccgggccgagcgcgucaucgacccccggcgcugcaugaagcccgugauccugaccgacggggaggagcgggugauccucgccggccccaugccggucacccacagcuccgccgcccagcgccgcgggcggaucggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcaucaagaacaaccagauccuggaggagaacguggaggucgagaucuggaccaaggagggggagcgcaagaagcucaagccgcgguggcuggacgcccgcaucuacuccgacccccuggcgcucaaggaguucaaggaguucgccgccggccggaagucccugacccugaaccucaucaccgagaugggccgccugcccacguucaugacccagaaggcccgggacgcccuggacaaccucgcggugcugcacaccgccgaggccgggggccgcgccuacaaccacgcccuguccgagcuccccgagacccuggagacgcugcuccugcugacccuccuggcgaccgucaccgggggcaucuuccuguuccucaugagcggcaaggggaucggcaagaugacgcuggggaugugcugcaucaucaccgccuccauccugcucugguacgcccagauccagccgcacuggaucgccgccagcaucauccuggaguucuuccugaucgugcuccugauccccgagcccgagaagcagcggacgccccaggacaaccagcugaccuacguggucaucgcgauccucaccgugguggccgccacgauggccaacgagaugggcuuccuggagaagaccaagaaggaccuggggcucggcagcaucaccacccaggaguccgagagcaacauccuggacaucgaccugcgcccggccuccgcguggacgcucuacgccgucgccaccaccuucgugacccccaugcugcggcacagcaucgagaacuccagcgugaacgucucccugacggccaucgcgaaccaggccaccgugcucaugggccuggggaagggcuggccccugagcaagauggacaucggggugccccuccuggccaucggcugcuacucccaggucaacccgaucacccugaccgccgcccuccugcugcucguggcgcacuacgccaucaucgggcccggccugcaggccaaggccacgcgcgaggcccagaagcgcgcggccgccggcaucaugaagaaccccaccguggacgggaucaccgucaucgaccuggagcccaucccguacgaccccaaguucgagaagcagcucggccaggugaugcugcugauccucugcgugacccagguccugaugaugcggacgaccugggcccugugcgaggcccucacccuggcgaccgggcccaucagcacgcugugggagggcaaccccgggcgcuucuggaacaccaccaucgccguguccauggccaacaucuuccggggcagcuaccucgccggcgcggggcugcuguucuccaucaugaagaacaccacgaacacccgccggggcaccgggaacaucggcgagacccucggcgagaaguggaagucccgccugaacgcccuggggaaguccgaguuccagaucuacaagaaguccggcauccaggagguggaccggacgcucgccaaggaggggaucaagcgcggcgagaccgaccaccacgccgucucccgggggagcgccaagcugcgcugguucguggagcggaacauggugaccccggagggcaaggucguggaccugggcugcgggcgcggcgggugguccuacuacugcggcgggcucaagaacgugcgggaggucaagggccugaccaagggcgggcccggccacgaggagcccauccccaugagcacguacggguggaaccuggugcgccuccagagcggcguggacgucuucuucaccccgcccgagaagugcgacacccugcugugcgacaucggggaguccagccccaaccccaccaucgaggcgggccggacgcuccgcgugcugaaccugguggagaacuggcucaacaacaacacccaguucugcaucaagguccugaacccguacaugcccuccgugaucgagaagauggagacccugcagcggaaguacggcggggcccuggugcgcaacccccucagccggaacuccacccacgagauguacugggucagcaacgccaccggcaacaucguguccagcgugaacaugaucucccgcaugcugaucaaccgcuucacgaugaagcacaagaaggccaccuacgagccggacgucgaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgcguccagcauggugaacggcgugguccggcugcugaccaagcccugggacguggugccgauggucacgcagauggccaugaccgacaccacccccuucgggcagcagcgcguguucaaggagaagguggacacgcggacccaggagcccaaggagggcaccaagaagcucaugcgcaucaccgccgaguggcuguggaaggagcugggcaagaagaagacgccccggaugugcacccgcgaggaguucacccggaagguccgcuccaacgccgcccucggggcgaucuucaccgacgagaacaaguggaaguccgcccgggaggccguggaggacucccgcuucugggagcugguggaccgggagcgcaaccugcaccucgagggcaagugcgagacgugcgucuacaacaugauggggaagcgggagaagaagcugggcgaguucgggaaggccaagggcagccgcgcgaucugguacauguggcugggcgcccgguuccucgaguucgaggcccugggguuccugaacgaggaccacugguucagccgcggcaacucccucagcgggguggagggcgaggggcugcaccggcugggcuacauccuccgcgacgucuccaagaaggagggcggggccauguacgccgacgacaccgcgggcugggacacccggaucacccuggaggaccugaagaacgaggagauggugacgaaccacaugcgcggggagcacaagaagcucgccgaggccaucuucaagcugaccuaccagaacaaggugguccgcgugcagcggccgacgccccggggcaccgugauggacaucaucagccggcgcgaccagcggggguccggccaggucggcacguacgggcugaacaccuucaccaacauggaggcccagcucauccgccagauggagggcgaggggaucuucaagagcaucaagcaccugaccgugacggaggagaucgccgugcagaacuggcuggcgcgggucggccgcgagcggcucucccgcauggccaucagcggcgacgacugcguggugaagccccuggacgaccgguucgccuccgcccugaccgcccucaacgacauggggaagguccgcaaggacauccagcagugggagcccagccggggcuggaacgacuggacccaggugccguucugcucccaccacuuccacgagcuggugaugaaggacgggcgcguccugguggugcccugccggaaccaggacgagcucaucggccgcgcgcggaucagccagggggccggcuggucccugaaggagaccgccugccugggcaagagcuacgcccagauguggacgcucauguacuuccaccgccgggaccugcgccuggccgcgaacgccaucugcuccgccguccccagccacugggugcccaccucccgcaccaccuggagcauccacgccaagcacgaguggaugaccacggaggacaugcucgcgguguggaaccgggucuggauccaggagaacccguggauggaggacaagacccccguggagagcugggaggaggugcccuaccuggggaagcgcgaggaccaguggugcggcucccugaucgggcucaccagccgggccaccugggccaagaacauccagacggccaucaaccagguccgcucccugaucggcaacgaggaguacaccgacuacaugcccagcaugaagcgguuccgccgggaggaggaggaggccggggugcugugguga

SEQ ID NO: 9493 - RNA, 9876 nt, Artificial Sequence
  derived and/or modified CDS sequence (opt1) from DENV-2__GQ868540__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugguggacgggcccgagaccgccgagugcccgaacaccaaccgggccuggaacagccucgaggucgaggacuacggcuucgggguguucaccacgaacaucuggcugaagcugcgcgagaagcaggacguguucugcgacuccaagcucaugagcgccgcgaucaaggacaaccgggccguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgcggggcccgucucccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggugaacagccucgugacggccgggcacggccagaucgacaacuucucccugggcguccuggggauggcccucuuccuggaggagaugcugcggacccgcgugggcaccaagcacgccauccuccugguggccgucagcuucgugacccugaucacggggaacauguccuuccgggaccucggccgcgugauggucauggugggggccaccaugaccgacgacaucggcaugggcgugaccuaccuggcccugcucgcggccuucaagguccgccccacguucgccgccgggcugcugcuccggaagcugaccagcaaggagcugaugauggccaccaucggcaucgcgcuccugucccagagcaccauccccgagacgauccuggagcucaccgacgcccuggcccuggggaugauggugcucaagaucgugcgcaacauggagaaguaccagcuggccgucaccaucauggccaucuccugcgugccgaacgcggugauccugcucaacgccuggaaggucagcugcaccauccuggccgccguguccgucagcccccugcuccugacguccagccagcagaaggcggacuggaucccccuggcccucaccaucaagggccugaaccccaccgccaucuuccugaccacgcucucccggaccagcaagaagcgcuccuggccgcugaacgaggccgugauggccgugggcauggucagcauccuggcguccagccuccugaagaacgacauccccaugaccgggccccugguggccggcgggcuccugaccgugugcuacguccugacgggccggagcgccgaccucgagcuggagcgcgccgccgacgugaagugggaggaccaggcggagaucuccgggagcucccccauccugagcaucaccaucuccgaggacggcagcauguccaucaagaacgaggaggaggagcagacccucaccauccugauccggacgggccugcucgugaucagcggggucuucccgguguccauccccaucaccgccgccgccugguaccugugggaggugaagaagcagcgcgccggcguccugugggacgugcccagcccgccgcccguggggaaggcggagcucgaggacggcgccuaccggaucaagcagcgcgggauccugggcuacucccagaucggcgccggggucuacaaggagggcaccuuccacaccauguggcacgugacccgcggggcggugcugaugcaccgcggcaagcggaucgagcccagcugggccgacgucaagaaggaccucaucuccuacgggggcggcuggaagcuggagggggaguggaaggagggcgaggagguccaggugcuggcgcucgagcccgggaagaacccccgcgccguccagacgaagcccggccuguucaagaccaacaccgggaccaucggcgccgugagccuggacuucucccccggcacgagcgggucccccaucguggaccggaagggcaaggucguggggcucuacggcaacggcguggucacccgcagcggggccuacguguccgcgaucgcccagaccgagaaguccaucgaggacaaccccgagaucgaggacgacaucuuccggaagaagcgccugaccaucauggaccugcaccccggcgccgggaagacgaagcgguaccugcccgccaucgugcgcgaggccaucaagcggggccuccgcacccugauccuggcgccgacccgcgucguggccgccgagauggaggaggcccuccgggggcugcccauccgcuaccagacccccgccauccgggcggagcacacgggccgcgagaucguggaccugaugugccacgccaccuucaccaugcggcuccugagccccguccgcgugccgaacuacaaccugaucaucauggacgaggcccacuucaccgaccccgccuccaucgccgcgcggggcuacaucagcacgcgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggucaccgacuucaaggggaagacggugugguucgugccguccaucaaggccggcaacgacaucgccgccugccuccgcaagaacggcaagaaggucauccagcugagccggaagaccuucgacuccgaguacgugaagacccgcgccaacgacugggacuucguggucaccacggacaucagcgagaugggggcgaacuuccgggccgagcgcgugaucgacccccggcgcugcaugaagcccgugauccugaccgacggcgaggagcgggucauccucgccgggcccaugccggugacccacuccagcgccgcccagcgccgcggccggaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaagguggacgccaucgacggggaguaccgccugcggggcgaggcccgcaagacguucgucgaccugaugcggcgcggggaccuccccguguggcuggccuaccggguggcggccgagggcaucaacuacgccgaccgccgguggugcuucgacgggaucaagaacaaccagauccuggaggagaacauggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucaccgagauggggcgccugcccacguucaugacccagaaggcccgggacgcccuggacaaccucgcggugcugcacaccgccgaggccggcgggcgcgccuacaaccacgcccugagcgagcuccccgagacccuggagacgcugcuccugcugacccuccuggcgaccgucaccggcggcaucuuccuguuccucauguccgggaagggcaucgggaagaugacgcugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucaccgugguggccgccacgauggccaacgagaugggguuccuggagaagaccaagaaggaccugggccucggcagcaucaccacccaggagagcgaguccaacauccuggacaucgaccugcgcccggccagcgcguggacgcucuacgccgucgccaccaccuucgugacccccaugcugcggcacuccaucgagaacagcuccgugaacgucagccugacggccaucgcgaaccaggccaccgugcucauggggcugggcaagggguggccccuguccaagauggacaucggcgugccccuccuggccaucgggugcuacagccaggucaacccgaucacccugaccgccgcccuccugcugcucguggcgcacuacgccaucaucggccccggccugcaggccaaggccacgcgcgaggcccagaagcgcgcggccgccgggaucaugaagaaccccaccguggacggcaucaccgucaucgaccuggagcccaucccguacgaccccaaguucgagaagcagcucggccaggugaugcugcugauccucugcgugacccagguccugaugaugcggacgaccugggcccugugcgaggcccucacccuggcgaccggccccaucuccacgcugugggaggggaaccccggccgcuucuggaacaccaccaucgccgugagcauggccaacaucuuccggggcuccuaccucgccggggcgggccugcuguucagcaucaugaagaacaccacgaacacccgccgggggaccggcaacaucggcgagacccucggggagaaguggaagucccgccugaacgcccugggcaagagcgaguuccagaucuacaagaaguccgggauccaggagguggaccggacgcucgccaaggagggcaucaagcgcggggagaccgaccaccacgccgucagccggggcuccgccaagcugcgcugguucguggagcggaacauggugaccccggagggcaaggucguggaccuggggugcggccgcgggggcuggagcuacuacugcgggggccucaagaacgugcgggaggucaagggccugaccaagggcgggcccgggcacgaggagcccauccccauguccacguacggcuggaaccuggugcgccuccagagcgggguggacgucuucuucaccccgcccgagaagugcgacacccugcugugcgacaucggcgagagcucccccaaccccaccaucgaggcgggccggacgcuccgcgugcugaaccugguggagaacuggcucaacaacaacacccaguucugcaucaagguccugaacccguacaugcccagcgugaucgagaagauggagacccugcagcggaaguacgggggcgcccuggugcgcaacccccucucccggaacagcacccacgagauguacugggucuccaacgccaccgggaacaucgugagcuccgugaacaugaucagccgcaugcugaucaaccgcuucacgaugaagcacaagaaggccaccuacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgcgagcuccauggugaacggggugguccggcugcugaccaagcccugggacguggugccgauggucacgcagauggccaugaccgacaccacccccuucggccagcagcgcguguucaaggagaagguggacacgcggacccaggagcccaaggagggcaccaagaagcucaugcgcaucaccgccgaguggcuguggaaggagcuggggaagaagaagacgccccggaugugcacccgcgaggaguucacccggaagguccgcagcaacgccgcccucggcgcgaucuucaccgacgagaacaaguggaaguccgcccgggaggccguggaggacagccgcuucugggagcugguggaccgggagcgcaaccugcaccucgaggggaagugcgagacgugcgucuacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgggaacagccucuccggcguggagggggagggccugcaccggcugggcuacauccuccgcgacgucagcaagaaggagggcggggccauguacgccgacgacaccgcggggugggacacccggaucacccuggaggaccugaagaacgaggagauggugacgaaccacaugaagggcgagcacaagaagcucgccgaggccaucuucaagcugaccuaccagaacaaggugguccgcgugcagcgcccgacgccccgggggaccgugauggacaucaucucccgccgggaccagcgcggcagcggccaggucgggacguacggccugaacaccuucaccaacauggaggcccagcucauccggcagauggagggggagggcaucuucaaguccauccagcaccugaccgugacggaggagaucgccgugcagaacuggcuggcgcgcgucggccgggagcgccucagccggauggccaucuccggggacgacugcguggugaagccccuggacgaccgcuucgccagcgcccugaccgcccucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucgggcgggcgcgcaucucccagggcgccggcuggagccugaaggagaccgccugccuggggaaguccuacgcccagauguggacgcucauguacuuccaccggcgcgaccugcggcuggccgcgaacgccaucugcagcgccguccccucccacugggugcccaccagccgcaccaccugguccauccacgccaagcacgaguggaugaccacggaggacaugcucgcgguguggaaccgcgucuggauccaggagaacccguggauggaggacaagacccccguggagagcugggaggagauccccuaccugggcaagcgggaggaccaguggugcgggagccugaucggccucaccucccgcgccaccugggccaagaacauccagacggccaucaaccaggugcggagccugaucgggaacgaggaguacaccgacuacaugcccuccaugaagcgcuuccggcgcgaggaggaggaggccggcguccugugguga

SEQ ID NO: 9494 - RNA, 9876 nt, Artificial Sequence
  derived and/or modified CDS sequence (opt1) from DENV-2__GQ868541__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggccaccaugaccgacgacaucggcaugggcgugaccuaccuggcccugcucgcggccuucaaggugcgccccacguucgccgccgggcugcugcuccggaagcugaccagcaaggagcugaugauggccaccaucggcaucgcgcuccugucccagagcaccauccccgagacgauccuggagcucaccgacgcccuggcccuggggaugaugguccucaagaucgugcgcaacauggagaaguaccagcuggccgugaccaucauggccaucuccugcgucccgaacgcggugauccugcucaacgccuggaaggugagcugcaccauccuggccgccgucuccgugagcccccugcuccugacguccagccagcagaaggcggacuggaucccccuggcccucaccaucaagggccugaaccccaccgccaucuuccugaccacgcucucccggaccagcaagaagcgcuccuggccgcugaacgaggccgucauggccgugggcauggugagcauccuggcguccagccuccugaagaacgacauccccaugaccgggccccuggucgccggcgggcuccugaccgugugcuacgugcugacgggccggagcgccgaccucgagcuggagcgcgccgccgacgucaagugggaggaccacgcggagaucuccgggagcucccccauccugagcaucaccaucuccgaggacggcagcauguccaucaagaacgaggaggaggagcagacccucaccauccugauccggacgggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcaccuuccacaccauguggcacgucacccgcggggcggugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagacgaagcccggccuguucaagaccaacaccgggaccaucggcgccgucagccuggacuucucccccggcacgagcgggucccccaucguggaccggaagggcaagguggucgggcucuacggcaacggcguggugacccgcagcggggccuacgucuccgcgaucgcccagaccgagaaguccaucgaggacaaccccgagaucgaggacgacaucuuccggaagaagcgccugaccaucauggaccugcaccccggcgccgggaagacgaagcgguaccugcccgccaucgugcgcgaggccaucaagcggggccuccgcacccugauccuggcgccgacccgcguggucgccgccgagauggaggaggcccuccgggggcugcccauccgcuaccagacccccgccauccgggcggagcacacgggccgcgagaucguggaccugaugugccacgccaccuucaccaugcggcuccugagccccgugcgcgucccgaacuacaaccugaucaucauggacgaggcccacuucaccgaccccgccuccaucgccgcgcggggcuacaucagcacgcgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugaccgacuucaaggggaagacggucugguucgugccguccaucaaggccggcaacgacaucgccgccugccuccgcaagaacggcaagaaggugauccagcugagccggaagaccuucgacuccgaguacgucaagacccgcgccaacgacugggacuucguggugaccacggacaucagcgagaugggggcgaacuuccgggccgagcgcgucaucgacccccggcgcugcaugaagcccgugauccugaccgacggcgaggagcgggugauccucgccgggcccaugccggucacccacuccagcgccgcccagcgccgcggccggaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaagguggacgccaucgacggggaguaccgccugcggggcgaggcccgcaagacguucguggaccugaugcggcgcggggaccuccccgucuggcuggccuaccggguggcggccgagggcaucaacuacgccgaccgccgguggugcuucgacgggaucaagaacaaccagauccuggaggagaacguggaggucgagaucuggaccaaggagggcgagcgcaagaagcucaagccgcgguggcuggacgcccgcaucuacagcgacccccuggcgcucaaggaguucaaggaguucgccgccggccggaagucccugacccugaaccucaucaccgagauggggcgccugcccacguucaugacccagaaggcccgggacgcccuggacaaccucgcggugcugcacaccgccgaggccggcgggcgcgccuacaaccacgcccugagcgagcuccccgagacccuggagacgcugcuccugcugacccuccuggcgaccgucaccggcggcaucuuccuguuccucauguccgggaagggcaucgggaagaugacgcugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucaccgugguggccgccacgauggccaacgagaugggguuccuggagaagaccaagaaggaccugggccucggcagcaucaccacccaggagagcgaguccaacauccuggacaucgaccugcgcccggccagcgcguggacgcucuacgccgucgccaccaccuucgugacccccaugcugcggcacuccaucgagaacagcuccgugaacgucagccugacggccaucgcgaaccaggccaccgugcucauggggcugggcaagggguggccccuguccaagauggacaucggcgugccccuccuggccaucgggugcuacagccaggucaacccgaucacccugaccgccgcccuccugcugcucguggcgcacuacgccaucaucggccccggccugcaggccaaggccacgcgcgaggcccagaagcgcgcggccgccgggaucaugaagaaccccaccguggacggcaucaccgucaucgaccuggagcccaucccguacgaccccaaguucgagaagcagcucggccaggugaugcugcugauccucugcgugacccagguccugaugaugcggacgaccugggcccugugcgaggcccucacccuggcgaccggccccaucuccacgcugugggaggggaaccccggccgcuucuggaacaccaccaucgccgugagcauggccaacaucuuccggggcuccuaccucgccggggcgggccugcuguucagcaucaugaagaacaccacgaacacccgccgggggaccggcaacaucggcgagacccucggggagaaguggaagucccgccugaacgcccugggcaagagcgaguuccagaucuacaagaaguccgggauccaggagguggaccggacgcucgccaaggagggcaucaagcgcggggagaccgaccaccacgccgucagccggggcuccgccaagcugcgcugguucguggagcggaacauggugaccccggagggcaaggucguggaccuggggugcggccgcgggggcuggagcuacuacugcgggggccucaagaacgugcgggaggucaagggccugaccaagggcgggcccgggcacgaggagcccauccccauguccacguacggcuggaaccuggugcgccuccagagcgggguggacgucuucuucaccccgcccgagaagugcgacacccugcugugcgacaucggcgagagcucccccaaccccaccaucgaggcgggccggacgcuccgcgugcugaaccugguggagaacuggcucaacaacaacacccaguucugcaucaagguccugaacccguacaugcccagcgugaucgagaagauggagacccugcagcggaaguacgggggcgcccuggugcgcaacccccucucccggaacagcacccacgagauguacugggucuccaacgccaccgggaacaucgugagcuccgugaacaugaucagccgcaugcugaucaaccgcuucacgaugaagcacaagaaggccaccuacgagccggacgucgaccugggcuccgggacccggaacaucggcaucgagagcgagauccccaaccucgacaucaucggcaagcgcaucgagaagaucaagcaggagcacgagaccuccuggcaccacgaccaggaccaccccuacaagacgugggccuaccacgggagcuacgagaccaagcagaccggcuccgcgagcuccauggugaacggggugguccggcugcugaccaagcccugggacguggugccgauggucacgcagauggccaugaccgacaccacccccuucggccagcagcgcguguucaaggagaagguggacacgcggacccaggagcccaaggagggcaccaagaagcucaugcgcaucaccgccgaguggcuguggaaggagcuggggaagaagaagacgccccggaugugcacccgcgaggaguucacccggaagguccgcagcaacgccgcccucggcgcgaucuucaccgacgagaacaaguggaaguccgcccgggaggccguggaggacagccgcuucugggagcugguggaccgggagcgcaaccugcaccucgaggggaagugcgagacgugcgucuacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgggaacagccucuccggcguggagggggagggccugcaccggcugggcuacauccuccgcgacgucagcaagaaggagggcggggccauguacgccgacgacaccgcggggugggacacccggaucacccuggaggaccugaagaacgaggagauggugacgaaccacaugaagggcgagcacaagaagcucgccgaggccaucuucaagcugaccuaccagaacaaggugguccgcgugcagcgcccgacgccccgggggaccgugauggacaucaucucccgccgggaccagcgcggcagcggccaggucgggacguacggccugaacaccuucaccaacauggaggcccagcucauccggcagauggagggggagggcaucuucaaguccauccagcaccugaccgugacggaggagaucgccgugcagaacuggcuggcgcgcgucggccgggagcgccucagccggauggccaucuccggggacgacugcguggugaagccccuggacgaccgcuucgccagcgcccugaccgcccucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucgggcgggcgcgcaucucccagggcgccggcuggagccugaaggagaccgccugccuggggaaguccuacgcccagauguggacgcucauguacuuccaccggcgcgaccugcggcuggccgcgaacgccaucugcagcgccguccccucccacugggugcccaccagccgcaccaccugguccauccacgccaagcacgaguggaugaccacggaggacaugcucgcgguguggaaccgcgucuggauccaggagaacccguggauggaggacaagacccccguggagagcugggaggaggugcccuaccugggcaagcgggaggaccaguggugcgggagccugaucggccucaccucccgcgccaccugggccaagaacauccagacggccaucaaccagguccggagccugaucgggaacgaggaguacaccgacuacaugcccuccaugaagcgcuuccggcgcgaggaggaggaggccggcgugcugugguga

SEQ ID NO: 9495 - RNA, 9876 nt, Artificial Sequence
  derived and/or modified CDS sequence (opt1) from DENV-2__GQ868603__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuuccucugcaagcacuccaugguggaccggggcugggggaacggcugcgggcuguucggcaagggcgggaucgugaccugcgcgauguucacgugcaagaagaacauggagggcaaggucgugcugcccgagaaccucgaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccgcaccggccuggacuucaacgagauggugcuccugcagauggaggacaaggccuggcugguccaccggcagugguuccucgaccugccccugcccuggcucccgggggccgacacccagggcagcaacuggauccagaaggagacgcuggugaccuucaagaacccccacgcgaagaagcaggacguggucgugcuggggucccaggagggcgccaugcacaccgcccucaccggggccacggagauccagaugagcagcggcaaccugcuguucaccggccaccucaagugccgccugcggauggacaagcugcagcucaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccuggggcgccucaucaccgugaacccgaucgugaccgagaaggacagccccgucaacaucgaggcggagccgcccuucggcgacuccuacaucaucaucgggguggagccgggccagcugaagcugaacugguucaagaaggggagcuccaucggccagauguucgagaccacgaugcgcggcgccaagcggauggccauccucggggacaccgccugggacuucggcagccucggcgggguguucaccuccaucgggaaggcccugcaccaggucuucggggcgaucuacggcgccgccuucagcgggguguccuggaccaugaagauccugaucggcgugaucaucacguggaucgggaugaacagccgcuccaccagccucuccgucagccuggugcuggugggcgucgugacccucuaccugggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcucgccuccgccauccagaaggcccacgaggagggcaucugcgggauccggagcgucacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaagaccuggggcaaggcgaagaugcugagcacggagucccacaaccagaccuuccucaucgacgggcccgagaccgccgagugcccgaacaccaaccgggccuggaacagccuggagguggaggacuacggcuucggggucuucacgaccaacaucuggcugaagcuccgcgagaagcaggacgugcugugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucgccgccgugagcuucgugacgcugaucaccgggaacauguccuuccgggaccugggccgcgucauggugauggugggggccaccaugaccgacgacaucggcaugggcgucacguaccucgcccugcuggcggccuucaaggugcgccccaccuucgccgccgggcuccugcugcggaagcucaccagcaaggagcugaugauggccaccaucggcaucgcgcugcucucccagagcacgauccccgagaccauccuggagcugaccgacgcccucgcccuggggaugauggugcugaagaucguccgcaacauggagaaguaccagcucguggugaccaucauggccaucuccugcgucccgaacgccgugauccugcagaacgcguggaaggugagcugcacgauccuggccgccgucuccgugagcccccuccugcugaccuccagccggcagaaggccgacuggaucccccucgcgcugaccaucaagggccugaaccccaccgccaucuuccucacgacccugucccgcaccagcaagaagcgguccuggccgcugaacgaggccaucauggccgucggcauggugagcauccucgccuccagccugcugaagaacgacauccccaugaccgggccccucguggcgggcgggcugcugacggucugcuacgugcucaccggccgcagcgccgaccuggagcuggagcgggccgccgacgugaagugggaggaccaggccgagaucuccgggagcucccccauccucagcaucaccaucuccgaggacggcagcauguccaucaagaacgaggaggaggagcagacccugacgauccugauccgcaccggccuccuggucaucagcgggguguucccgguguccauccccaucaccgcggccgccugguaccugugggaggucaagaagcagcgggccggcgugcucugggacgugcccagcccgccgcccgucgggaaggccgagcuggaggacggcgcguaccgcaucaagcagcgggggauccugggcuacucccagaucggcgccgggguguacaaggagggcaccuuccacaccauguggcacgugacgcgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggcggugcagaccaagcccggccuguucaagaccaacaccgggacgaucggcgccgugagccucgacuucucccccggcaccagcgggucccccaucgucgaccgcaagggcaaggugguggggcuguacggcaacggcgucgugacccggagcggggccuacguguccgccaucgcgcagaccgagaaguccaucgaggacaaccccgagaucgaggacgacaucuuccgcaagaagcggcugacgaucauggaccugcaccccggcgccgggaagaccaagcgcuaccuccccgccaucguccgggaggccaucaagcgcggccugcgcacccugauccucgccccgacccgggugguggcggccgagauggaggaggcccugcgcgggcugcccauccgguaccagacgcccgccauccgcgccgagcacaccggccgggagaucgucgaccucaugugccacgcgaccuucaccaugcgccugcugagccccgugcgggugccgaacuacaaccucaucaucauggacgaggcccacuucacggaccccgccuccaucgccgcccgcggcuacaucagcacccgggucgagaugggggaggcggccggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgugugguucgucccguccaucaaggcgggcaacgacaucgccgccugccugcggaagaacggcaagaaggugauccagcugagccgcaagaccuucgacuccgaguacgugaagacccgggccaacgacugggacuucgucgugacgaccgacaucagcgagaugggggccaacuucaaggcggagcgcgugaucgacccccggcgcugcaugaagcccgucauccucaccgacggcgaggagcgggugauccuggccgggcccaugccggugacccacuccagcgccgcccagcgccgcggccggaucgggcgcaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgggagaaggucgacgccaucgacggggaguaccgccugcggggcgaggcccgcaagaccuucguggaccucaugcggcgcggggaccugcccguguggcuggccuaccgggucgccgcggagggcaucaacuacgccgaccgccgguggugcuucgacgggaucaagaacaaccagauccucgaggagaacguggagguggagaucuggaccaaggagggcgagcgcaagaagcugaagccgcgguggcuggacgcccgcaucuacagcgacccccucgcccugaaggaguucaaggaguucgcggccggccggaagucccugacccucaaccugaucacggagauggggcgccugcccaccuucaugacccagaaggcccgggacgcccucgacaaccuggccguccugcacaccgcggaggccggcgggcgcgccuacaaccacgcccucagcgagcugcccgagacgcuggagacccuccugcugcucacccugcuggccaccgugacgggcggcaucuuccucuuccugauguccgggaagggcgucgggaagaugacccugggcaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacguggucaucgccauccugacggugguggcggccaccauggccaacgagaugggguuccuggagaagaccaagaaggaccucggccugggcagcaucaccacgcaggagagcgaguccaacauccuggacaucgaccuccgcccggccagcgccuggacccuguacgcggucgccaccaccuucuucacgcccaugcugcggcacuccaucgagaacagcuccgugaacgugagccucaccgccaucgccaaccaggcgaccguccugauggggcugggcaagggguggccccucuccaagauggacaucggcgugccccugcuggccaucgggugcuacagccaggugaacccgaucacccucacggccgcccugcugcuccuggucgcccacuacgcgaucaucggccccggccugcaggccaaggccacccgcgaggcccagaagcgcgccgcggccgggaucaugaagaaccccaccguggacggcaucaccgugaucgaccucgagcccaucccguacgaccccaaguucgagaagcagcuggggcaggucaugcugcucauccugugcgugacccaggugcugaugaugcggaccaccugggcccucugcgaggcccugacccuggccacgggccccaucuccacccucugggaggggaaccccggccgcuucuggaacaccaccaucgcggucagcauggccaacaucuuccggggcuccuaccuggccggggccggccugcuguucagcaucaugaagaacacgaccaacacccgccgggggaccggcaacaucggcgagacgcugggggagaaguggaagucccgccugaacgcgcucggcaagagcgaguuccagaucuacaagaaguccgggauccaggagguggaccggacccuggccaaggagggcaucaagcgcggggagaccgaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugacgaagggcggccccgggcacgaggagcccauccccauguccaccuacggcuggaaccucguccgccugcagagcgggguggacguguucuucaccccgcccgagaagugcgacacccugcucugcgacaucggcgagagcucccccaaccccacgaucgaggccggccggacccugcgcguccugaaccucguggagaacuggcugaacaacaacacccaguucugcaucaaggugcugaacccguacaugcccagcgucaucgagaagauggagacccugcagcggaaguacgggggcgcgcucgugcgcaacccccugucccggaacagcacccacgagauguacuggguguccaacgccacggggaacaucgucagcuccgugaacaugaucagccgcaugcugaucaaccgcuucaccaugaagcacaagaaggccaccuacgagccggacguggaccucggcuccgggacccggaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggucaacgggguggugcggcugcucacgaagcccugggacgucgugccgauggugacccagauggcgaugaccgacaccacgcccuucggccagcagcgcgucuucaaggagaagguggacacccggacccaggagcccaaggagggcaccaagaagcugaugaagaucacggccgaguggcuguggaaggagcucgggaagaagaagaucccccgcaugugcacccgggaggaguucacccgcaaggugcggagcaacgccgcccugggcgccaucuucaccgacgagaacaaguggaaguccgcgcgcgaggccgucgaggacagccgguucugggagcugguggaccgcgagcggaaccuccaccuggaggggaagugcgagacgugcguguacaacaugaugggcaagcgcgagaagaagcugggggaguucggcaaggccaagggcucccgggccaucugguacauguggcucggggcgcgcuuccuggaguucgaggcccugggcuuccucaacgaggaccacugguucagccgggggaacagccuguccggcgucgagggggagggccugcaccgccucggcuacauccugcgggacgugagcaagaaggagggcggcgccauguacgccgacgacaccgccgggugggacacccgcaucacccuggaggaccucaagaacgaggagauggucacgaaccacaugaagggcgagcacaagaagcuggcggaggccaucuucaagcugaccuaccagaacaagguggugcggguccagcgcccgacgccccgcgggaccgugauggacaucaucucccggcgcgaccagcggggcagcggccagguggggacguacggccucaacaccuucaccaacauggaggcccagcugauccgccagauggagggggagggcaucuucaaguccauccagcaccugaccgucacggaggagaucgccgugcagaacuggcucgcccgggugggccgcgagcggcugagccgcauggcgaucuccggggacgacugcgucgugaagccccuggacgaccgguucgccagcgcccucaccgcccugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucgggcgcgcccggaucucccagggcgcgggcuggagccugaaggagaccgccugccucgggaaguccuacgcccagauguggacgcugauguacuuccaccgccgggaccugcgccucgccgccaacgcgaucugcagcgccgugcccucccacuggguccccaccagccggaccaccugguccauccacgccaagcacgaguggaugaccacggaggacaugcuggccguguggaaccgcguguggauccaggagaacccguggauggaggacaagacccccgucgagagcugggaggaggugcccuaccugggcaagcgcgaggaccaguggugcgggagccucaucggccugaccucccgggcgaccugggccaagaacauccagacggccaucaaccaggugcgcagccugaucgggaacgaggaguacaccgacuacaugcccuccaugaagcgguuccgccgggaggaggaggaggccggcguccucugguga

SEQ ID NO: 9496 - RNA, 9876 nt, Artificial Sequence
  derived and/or modified CDS sequence (opt1) from DENV-2__FJ898450__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggccauggugcaggcggacuccggcugcgucgugagcuggaagaacaaggagcugaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgagguggaggacuacggcuucggggucuucacgaccaacaucuggcugaagcugcgcgagaagcaggacgccuucugcgacuccaagcucaugagcgccgcgaucaaggacaaccgggccgugcacgccgacaugggcuacuggaucgaguccgcccugaacgacaccuggaagauggagaaggccagcuucaucgaggugaaguccugccacuggcccaagagccacacccugugguccaacggcguccucgagagcgagaugaucauccccaagaacuucgcggggcccgugucccagcacaacuaccgcccgggcuaccacacccagacggccgggcccuggcaccugggcaagcuggagauggacuucgacuucugcgaggggaccaccguggucgugaccgaggacugcggcaaccggggccccagccuccgcacgaccaccgccagcgggaagcugaucaccgaguggugcugccgguccugcacgcugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcgugggcaccaagcacgccauccuccuggucgccgugagcuucgugacgcugaucaccgggaacauguccuuccgggaccucggccgcgucauggugauggugggggccaccaugaccgacgacaucggcaugggcgucacguaccuggcccugcucgcggccuucaaggugcgccccaccuucgccgccgggcugcugcuccggaagcugaccagcaaggagcugaugauggccaccaucggcaucgcgcuccugucccagagcacgauccccgagaccauccuggagcucaccgacgcccuggcccuggggaugauggugcucaagaucguccgcaacauggagaaguaccagcuggccgugaccaucauggccaucuccugcgugccgaacgcggucauccugcagaacgccuggaaggugagcugcacgauccucgccgccguguccgucagcccccugcugcucaccuccagccagcagaaggcggacuggaucccccuggcccugaccaucaagggccucaaccccaccgccaucuuccugacgacccugucccggaccagcaagaagcgcuccuggccgcucaacgaggccgugauggccgucggcauggugagcauccuggcguccagccugcucaagaacgacauccccaugaccgggccccugguggccggcgggcugcucacggucugcuacgugcugaccggccggagcgccgaccuggagcucgagcgcgccgccgacgugaagugggaggaccaggcggagaucuccgggagcucccccauccugagcaucaccaucuccgaggacggcagcauguccaucaagaacgaggaggaggagcagacccugacgauccucauccggaccggccugcuggucaucagcgggguguucccgguguccauccccaucaccgccgccgccugguaccucugggaggucaagaagcagcgcgccggcgugcugugggacgugcccagcccgccgcccgucgggaaggcggagcuggaggacggcgccuaccggaucaagcagcgcgggauccucggcuacucccagaucggcgccgggguguacaaggagggcaccuuccacaccauguggcacgugacgcgcggggcgguccugaugcaccgcggcaagcggaucgagcccagcugggccgacgugaagaaggaccugaucuccuacgggggcggcuggaagcucgagggggaguggaaggagggcgaggaggugcagguccuggcgcuggagcccgggaagaacccccgcgccgugcagaccaagcccggccucuucaagaccaacaccgggacgaucggcgccgugagccuggacuucucccccggcaccagcgggucccccaucgucgaccggaagggcaaggugguggggcuguacggcaacggcgucgugacccgcagcggggccuacguguccgcgaucgcccagaccgagaaguccaucgaggacaaccccgagaucgaggacgacaucuuccggaagaagcgccucacgaucauggaccugcaccccggcgccgggaagaccaagcgguaccugcccgccaucguccgcgaggccaucaagcggggccugcgcacccucauccuggcgccgacccgcgugguggccgccgagauggaggaggcccugcgggggcuccccauccgcuaccagacgcccgccauccgggcggagcacaccggccgcgagaucgucgaccugaugugccacgccaccuucaccaugcggcugcucagccccgugcgcgugccgaacuacaaccugaucaucauggacgaggcccacuucacggaccccgccuccaucgccgcgcggggcuacaucagcacccgcgucgagaugggggaggccgccggcaucuucaugaccgccacgccgcccgggucccgggacccguucccccagagcaacgcgcccaucauggacgaggagcgcgagauccccgagcgguccuggaacagcggccacgagugggugacggacuucaaggggaagaccgugugguucgucccguccaucaaggccggcaacgacaucgccgccugccugcgcaagaacggcaagaaggugauccagcucagccggaagaccuucgacuccgaguacgugaagacccgcgccaacgacugggacuucgucgugacgaccgacaucagcgagaugggggcgaacuuccgggccgagcgcgugaucgacccccggcgcugcaugaagcccgucauccugaccgacggcgaggagcgggugauccuggccgggcccaugccggugacccacuccagcgccgcccagcgccgcggccggaucgggcgcaaccccaagaacgagaacgaccaguacaucuacaugggcgagccccucgagaacgacgaggacugcgcgcacuggaaggaggccaagaugcugcuggacaacaucaacacgcccgagggcaucaucccguccauguucgagcccgagcgggagaaggucgacgccaucgacggggaguaccgccuccggggcgaggcccgcaagaccuucguggaccugaugcggcgcggggaccugcccguguggcucgccuaccgggucgcggccgagggcaucaacuacgccgaccgccgguggugcuucgacgggaucaagaacaaccagauccuggaggagaacguggagguggagaucuggaccaaggagggcgagcgcaagaagcugaagccgcgguggcucgacgcccgcaucuacagcgacccccuggcgcugaaggaguucaaggaguucgccgccggccggaagucccucacccugaaccugaucacggagauggggcgccuccccaccuucaugacccagaaggcccgggacgcccuggacaaccuggcgguccuccacaccgccgaggccggcgggcgcgccuacaaccacgcccugagcgagcugcccgagacgcucgagacccugcugcuccugacccugcucgcgaccgugacgggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucguccugcucauccccgagcccgagaagcagcggacgccccaggacaaccagcugaccuacguggugaucgcgauccugacggucguggccgccaccauggccaacgagaugggguuccucgagaagaccaagaaggaccugggccugggcagcaucaccacgcaggagagcgaguccaacauccucgacaucgaccugcgcccggccagcgcguggacccuguacgccguggccaccaccuucgucacgcccaugcuccggcacuccaucgagaacagcuccgugaacgugagccugaccgccaucgcgaaccaggccaccguccugauggggcucggcaagggguggccccuguccaagauggacaucggcgugccccugcucgccaucgggugcuacagccaggugaacccgaucacccugacggccgcccugcuccugcuggucgcgcacuacgccaucaucggccccggccuccaggccaaggccacccgcgaggcccagaagcgcgcggccgccgggaucaugaagaaccccaccguggacggcaucaccgugaucgaccuggagcccaucccguacgaccccaaguucgagaagcagcuggggcaggucaugcuccugauccugugcgugacccaggugcucaugaugcggaccaccugggcccugugcgaggcccugacccucgcgacgggccccaucuccacccugugggaggggaaccccggccgcuucuggaacaccaccaucgccgucagcauggccaacaucuuccggggcuccuaccuggccggggcgggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgccaagcuccgcugguucgucgagcggaacauggugaccccggagggcaagguggucgaccuggggugcggccgcgggggcuggagcuacuacugcgggggccugaagaacgugcgggaggugaagggccucacgaagggcgggcccgggcacgaggagcccauccccauguccaccuacggcuggaaccugguccgccugcagagcgggguggacguguucuucaccccgcccgagaagugcgacacccuccugugcgacaucggcgagagcucccccaaccccacgaucgaggcgggccggacccugcgcguccucaaccugguggagaacuggcugaacaacaacacccaguucugcaucaaggugcucaacccguacaugcccagcgucaucgagaagauggagacccugcagcggaaguacgggggcgcccuggugcgcaacccccugucccggaacagcacccacgagauguacuggguguccaacgccacggggaacaucgucagcuccgugaacaugaucagccgcaugcucaucaaccgcuucaccaugaagcacaagaaggccaccuacgagccggacguggaccugggcuccgggacccggaacaucggcaucgagagcgagauccccaaccuggacaucaucggcaagcgcaucgagaagaucaagcaggagcacgagacguccuggcacuacgaccaggaccaccccuaccggaccugggccuaccacgggagcuacgagaccaagcagaccggcuccgcgagcuccauggucaacgggguggugcgccuccugacgaagcccugggacgucgugccgauggugacccagauggccaugaccgacaccacgcccuucggccagcagcgggucuucaaggagaagguggacacccgcacccaggagcccaaggagggcaccaagaagcugaugcggaucacggccgaguggcucuggaaggagcuggggaagaagaagacgccccgcaugugcacccgggaggaguucacccgcaaggugcggagcaacgccgcccugggcgcgaucuucacggacgagaacaaguggaaguccgcccgcgaggccgucgaggacagccgguucugggagcucguggaccgcgagcggaaccugcaccuggaggggaagugcgagaccugcguguacaacaugaugggcaagcgcgagaagaagcucggggaguucggcaaggccaagggcucccgggcgaucugguacauguggcugggggcccgcuuccuggaguucgaggcccucggcuuccugaacgaggaccacugguucagccgggggaacagccuguccggcgucgagggggagggccuccaccgccugggcuacauccugcgggacgugagcaagaaggagggcggggccauguacgccgacgacaccgcggggugggacacccgcaucacgcucgaggaccugaagaacgaggagauggucaccaaccacaugaagggcgagcacaagaagcuggccgaggccaucuucaagcucaccuaccagaacaagguggugcgcguccagcggccgacgccccgcgggacggugauggacaucaucucccggcgcgaccagcggggcagcggccagguggggaccuacggccugaacaccuucaccaacauggaggcccagcugauccgccagauggagggggagggcaucuucaaguccauccagcaccucacggucaccgaggagaucgccgugcagaacuggcuggcgcgggugggccgcgagcggcugagccgcauggccaucuccggggacgacugcgucgugaagccccucgacgaccgguucgccagcgcccugaccgcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucgggcgcgcgcggaucucccagggcgccggcuggagccucaaggagacggccugccuggggaaguccuacgcccagauguggacccugauguacuuccaccgccgggaccuccgccuggccgcgaacgccaucugcagcgccgugcccucccacuggguccccaccagccgcaccaccugguccauccacgccaagcacgaguggaugacgaccgaggacaugcuggcgguguggaaccggguguggauccaggagaacccguggauggaggacaagacccccgucgagagcugggaggaggugcccuaccucggcaagcgcgaggaccaguggugcgggagccugaucggccugaccucccgggccacgugggccaagaacauccagaccgccaucaaccaggugcgcagccucaucgggaacgaggaguacaccgacuacaugcccuccaugaagcgguuccgccgggaggaggaggaggccggcguccugugguga

SEQ ID NO: 9497 - RNA, 9876 nt, Artificial Sequence
  derived and/or modified CDS sequence (opt1) from DENV-2__FJ898453__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccgcaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucuccaccaacaucuggcucaagcugcgcgagcggcaggacguguucugcgacagcaagcugauguccgccgccaucaaggacaaccgcgcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccuccgggaagcucaucacggaguggugcugccgcagcugcacccugcccccgcugcgguaccgcggcgaggacgggugcugguacggcauggagauccggccccucaaggagaaggaggagaaccuggucaacucccuggugaccgccgggcacggccagaucgacaacuucagccucggcgugcuggggauggcccuguuccucgaggagaugcugcgcacccgggucggcacgaagcacgcgauccugcucguggcccuguccuucgugacccugaucaccgggaacaugagcuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccuccaaggagcugaugauggccacgaucggcaucgcccuccugagccaguccacccugcccgagaccauccucgagcugaccgacgcgcuggcccucgggaugauggugcugaagaucguccggaacauggagaaguaccagcuggccgugacgaucauggccaucagcugcgugccgaacgccgucauccuccagaacgcguggaagguguccugcaccauccuggccgccgugagcgucagcccccugcuccugaccagcucccagcagaaggccgacuggaucccccuggcgcucaccaucaagggccugaaccccacggccaucuuccugaccacccucagccgcaccuccaagaagcggagcuggccgcugaacgaggccaucauggccgugggcauggucuccauccuggccagcagccuccugaagaacgacauccccaugacggggccccugguggcgggcgggcuccugaccgugugcuacguccugaccggccgcuccgccgaccucgagcuggagcgggccgccgacgugaagugggaggaccaggccgagaucagcggguccagccccauccuguccaucaccaucagcgaggacggcuccaugagcaucaagaacgaggaggaggagcagacgcucaccauccugauccgcaccggccugcucgugaucuccggggucuucccggugagcauccccaucaccgcggccgccugguaccugugggaggugaagaagcagcgggccggcguccugugggacgugcccagcccgccgcccguggggaaggccgagcucgaggacggcgucuaccgcaucaagcagcgggggauccugggcuacagccagaucggcgcggggguguacaaggagggcaccuuccacacgauguggcacgugacccgcggggccguccugaugcaccggggcaagcgcaucgagcccuccugggccgacgugaagaaggaccucaucagcuacgggggcggcuggaagcuggagggggaguggaaggagggcgaggaggugcagguccuggcccucgagcccgggaagaacccccgggccgugcagaccaagcccggcaucuucaagaccaacacggggaccaucggcgcggugucccuggacuucagccccggcaccuccgggagccccaucgucgaccgcaagggcaaggugguggggcuguacggcaacggcgucgugacccgguccggggccuacgugagcgccaucgcccagacggagaaguccaucgaggacaaccccgagaucgaggacgacaucuuccgcaagaagcggcucaccaucauggaccugcaccccggcgcggggaagaccaagcgcuaccugcccgccaucguccgggaggccaucaagcgcggccugcgcacccucauccuggccccgacgcgggugguggccgcggagauggaggaggcccugcgcgggcuccccauccgguaccagacccccgccauccgcgccgagcacaccggccgggagaucgucgaccugaugugccacgccaccuucacgaugcgccugcucucccccgugcgggugccgaacuacaaccugaucaucauggacgaggcgcacuucaccgaccccgccagcaucgccgcccgcggcuacaucuccacccgggucgagaugggggaggccgcgggcaucuucaugaccgccacgccgcccgggagccgcgacccguucccccaguccaacgcccccaucauggacgaggagcgggagauccccgagcgcagcuggaacuccggccacgagugggugaccgacuucaaggggaagaccgugugguucgucccgagcaucaaggccggcaacgacaucgcggccugccugcggaagaacggcaagaaggugauccagcucucccgcaagaccuucgacagcgaguacgugaagacgcgggccaacgacugggacuucgucgugaccaccgacaucuccgagaugggggccaacuucaaggccgagcgcgugaucgacccccggcgcugcaugaagcccgucauccugaccgacggcgaggagcgggugauccuggcggggcccaugccggugacgcacagcuccgccgcccagcgccgcggccggaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgggagaaggucgacgcgaucgacggggaguaccgccuccggggcgaggcccgcaagaccuucguggaccugaugcggcgcggggaccugcccguguggcucgccuacaaggucgccgccgagggcaucaacuacgcggaccggaaguggugcuucgacgggaucaagaacaaccagauccuggaggagaacguggagguggagaucuggaccaaggagggcgagcgcaagaagcugaagccgcgguggcucgacgcccgcaucuacuccgacccccuggcccugaaggaguucaaggaguucgccgcgggccggaagucccucacgcugaaccugaucaccgagauggggcgccuccccaccuucaugacccagaaggcccggaacgcccuggacaaccuggccguccuccacacggccgaggugggcgggcgcgcguacaaccacgcccuguccgagcugcccgagacccucgagacccugcugcuccugacccugcucgccacggucaccggcggcaucuuccuguuccugaugagcgggaagggcaucgggaagaugacccucggcaugugcugcaucaucaccgccuccauccugcugugguacgcccagauccagccgcacuggaucgcggccagcaucauccucgaguucuuccugaucgugcugcucauccccgagcccgagaagcagcggacgccccaggacaaccagcugacguacguggucaucgccauccugaccgugguggccgccaccauggcgaacgagaugggguuccucgagaagaccaagaaggaccugggcuucggcagcaucacgacccaggaguccgagagcaacauccuggacaucgaccuccgcccggccuccgccuggacccuguacgccgucgccaccacguucgugacccccaugcugcggcacagcaucgagaacuccagcgugaacgucucccucaccgcgaucgccaaccaggccaccgugcugauggggcugggcaagggguggccccucagcaagauggacaucggcgugccccugcuggccaucgggugcuacucccaggucaacccgaucacgcucaccgcggcccugcugcuccugguggcccacuacgccaucaucggccccggccugcaggccaaggcgacccgcgaggcccagaagcgggccgccgccgggaucaugaagaaccccaccguggacggcaucacggucaucgaccucgagcccaucccguacgaccccaaguucgagaagcagcuggggcaggucaugcugcucauccugugcgugacccagguccugaugaugcgcaccaccugggcgcucugcgaggcccugacgcuggccaccggccccaucagcacccucugggaggggaaccccggccgcuucuggaacaccacgaucgccguguccauggccaacaucuuccggggcagcuaccuggcgggggccggccuccuguucuccaucaugaagaacaccaccaacacccgccgggggacgggcaacgugggcgagacccugggggagaaguggaagucccgccugaacgcccucggcaaguccgaguuccagaucuacaagaaguccgggauccaggaggucgaccggacccuggccaaggagggcaucaagcgcggggagaccgaccaccacgcggugucccggggcagcgccaagcugcgcugguucguggagcggaacauggucgccccggagggcaaggugguggaccucgggugcggccgcgggggcugguccuacuacugcgggggccugaagaacguccgggaggugaagggccugacgaagggcgggcccgggcacgaggagcccauccccaugagcaccuacggcuggaaccucgugcgccugcagagcggggucgacguguucuucaccccgcccgagaagugcgacacccugcucugcgacaucggcgaguccagccccaaccccacgaucgaggccggccggacccugcgcgugcugaaccucgucgagaacuggcugaacaacaacacccaguucugcaucaaggugcugaacccguacaugcccuccgugaucgagaagauggagacccuccagcggaaguacgggggcgcccugguccgcaacccccugagccggaacuccacccacgagauguacugggugagcaacgcgacggggaacaucguguccagcgucaacaugaucucccgcaugcugaucaaccgguucaccaugaagcacaagaaggccaccuacgagccggacguggaccucggcagcgggacccgcaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggucgugcggcugcucacgaagcccugggacguggucccgauggugacccagauggccaugaccgacaccacgcccuucggccagcagcgcguguucaaggagaaggucgacacccggacccaggagcccaaggagggcaccaagaagcugaugaagaucacggcggaguggcuguggaaggagcucgggaaggagaagacgccccgcaugugcacccgggaggaguucacccgcaaggugcgguccaacgccgcccugggcgccaucuucacggacgagaacaaguggaaguccgcccgcgaggcgguggaggacgggcgguucugggagcuggucgaccgcgagcggaaccuccaccuggagggcaagugcgagaccugcguguacaacaugauggggaagcgcgagaagaagcugggcgaguucggcaaggccaaggggucccgggccaucugguacauguggcucggcgcccgcuuccuggaguucgaggcgcugggguuccucaacgaggaccacugguucagccggggcaacagccuguccggggucgagggcgagggccugcaccgccucggguacauccugcgggaggugggcaagaaggagggcggcgccauguacgccgacgacaccgccgggugggacacccgcaucacgcuggaggaccucaagaacgaggagauggugaccaaccacaugaagggcgagcacaagaagcuggccgaggcgaucuucaagcugaccuaccagaacaaggucgugcgggugcagcgcccgacgccccggggcacggucauggacaucaucagccgcaaggaccagcgcggguccggccagguggggaccuacggccucaacaccuucaccaacauggaggcccagcugauccggcagauggagggcgaggggaucuucaagagcauccagcaccugacggugaccgaggagaucgccguccagaacuggcucgcccgcgugggccgggagcgccugucccggauggccaucagcggggacgacugcguggucaagcccaucgacgaccgcuucgcguccgcccugaccgcccucaacgacaugggcaaggugcggaaggacauccagcagugggagcccagccgcggguggaacgacuggacccaggugccguucugcucccaccacuuccacgagcuggucaugaaggacggccgggugcuggugguccccugccgcaaccaggacgagcucaucggccgggcccgcaucagccagggggccggcuggucccugaaggagacggcgugccugggcaagagcuacgcccagauguggacccucauguacuuccaccggcgcgaccugcggcuggccgccaacgccaucugcuccgcggugcccagccacugggugcccaccucccgcaccaccuggagcauccacgccaagcacgaguggaugacgaccgaggacaugcucgccgucuggaaccggguguggauccaggagaacccguggauggaggacaagacccccguggaguccugggaggagguccccuaccugggcaagcgcgaggaccaguggugcgggagccugaucggccucaccagccgggccacgugggcgaagaacauccagaccgccaucaaccaggugcgcucccugaucggcaacgaggaguacaccgacuacaugcccagcaugaagcgcuuccggcgcgaggaggaggaggccggggugcugugguga

SEQ ID NO: 9498 - RNA, 9876 nt, Artificial Sequence
  derived and/or modified CDS sequence (opt1) from DENV-2__EU482445__SS-prME
agcgccgggaugaucaucaugcugauccccaccgugauggccuuccaccucaccacccggaacggggagccgcacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggacccugaagauccugaucggggugaucaucaccuggaucggcaugaacucccggagcaccucccugagcgucucccucgugcugguggggaucgucacgcuguaccucggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcucgagaaccugauguggaagcagaucacccccgagcugaaccacauccucgccgagaacgaggugaagcugaccaucaugaccggggacaucaagggcaucaugcaggccgggaagcgcagccugcggccgcagcccacggagcucaaguacuccuggaagaccuggggcaaggccaagaugcugagcaccgaguccuacaaccagaccuuccugaucgacggccccgagacgaccgagugcccgaacaccaaccgcgcguggaacagccucgagguggaggacuacggguucggcgucuucaccacgaacaucuggcugaagcugaaggagaagcaggacgccuucugcgacuccaagcucaugagcgccgccaucaaggacaaccgggccgugcacgcggacaugggguacuggaucgaguccgcccugaacgacaccuggaagaucgagaaggccagcuucaucgaggugaagaacugccacuggcccaagucccacacccuguggagcaacggcguccucgaguccgagaugaucauccccaagaaccuggccggccccgugagccagcacaacuaccgcccgggguaccacacccagaucgccggccccuggcaccuggggaagcucgagauggacuucgacuucugcgacggcaccacggugaucgucaccgaggacugcgggaaccggggccccucccugcgcaccaccacggcgagcggcaagcugaucaccgaguggugcugccggagcugcacccucccgccccugcgcuaccgcggggaggacggcugcugguacgggauggagauccgcccccugaaggagaaggaggagaaccucgugaacucccuggugaccgccggccacgggcaggucgacaacuucagccugggcgugcucggcauggcccuguuccuggaggagaugcuccggacgcgcguggggaccaagcacgccauccugcuggucgcgguguccuucgugacccucaucaccggcaacaugagcuucaaggaccuggggcgggucguggugauggucggcgccacgauggccgacgacaucgggaugggcgugaccuaccuggcccuccuggccgcguucaaggugcgccccaccuucgccgccggccugcuccugcggaagcugaccuccaaggagcucaugaugacgaccaucgggaucguccugcugagccaguccaccauccccgagaccgugcucgagcugacggacgcccuggcccucggcaugauggugcugaagaucguccgcaacauggagaaguaccagcuggcggugaccaucauggccauccucugcguccccaacgccgugauccugcagaacgccuggaaggugagcugcaccauccuggccgucguguccgugagcccccuccugcugaccuccagccagcagaagacggacuggaucccccucgcgcugaccaucaaggggcugaaccccaccgccaucuuccucaccacgcugucccgcaccaacaagaagcggagcuggccgcugaacgaggccaucauggccgucggcaugguguccauccucgcgagcucccugcugaagaacgacauccccaugaccggcccccucguggccgggggccugcugaccgucugcuacgugcucacggggcgcagcgccgaccuggagcuggagcgggccaccgacgugaagugggaggaccaggccgagaucuccggcagcagccccauccucuccaucaccaucagcgaggacggguccaugagcaucaagaacgaggaggaggagcagacccugacgauccugauccgcaccggccuccuggucaucuccggccuguucccgaucagcauccccaucaccgcggccgccugguaccucugggaggugaagaagcagcgggccggggugcugugggacguccccagcccgccgcccaugggcaaggccgagcuggaggacggggcguaccgcaucaagcagaagggcauccucggguacagccagaucggcgccggcguguacaaggaggggaccuuccacaccauguggcacgugacgcggggcgccguccugaugcacaaggggaagcgcaucgagcccuccugggccgacgugaagaaggaccugaucagcuacggcgggggcuggaagcucgagggcgaguggaaggagggggaggaggugcagguccuggcccuggagcccggcaagaacccccgggcggugcagaccaagcccggccucuucaagaccaacaccggcacgaucggggccgugucccuggacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccuccaccccggggcgggcaagaccaagcgcuaccugcccgccaucgugcgggaggccaucaagcgcgggcugcggacccucauccuggccccgacccgcgucguggcggccgagauggaggaggcccugcggggccuccccauccgcuaccagacgcccgccauccgggccgagcacaccgggcgcgagaucguggaccugaugugccacgcgaccuucaccaugcgccugcucagccccguccgggugccgaacuacaaccugaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacacggggcacgagugggucaccgacuucaagggcaagaccgugugguucgugccguccaucaaggccgggaacgacaucgcggccugccugcggaagaacggcaagaaggucauccagcucagccgcaagaccuucgacuccgaguacgugaagacgcggaccaacgacugggacuucguggucaccaccgacaucagcgagaugggcgccaacuucaaggccgagcgcgugaucgacccccggcgcugcaugaagcccgugauccugacggacggggaggagcgggucauccuggcgggccccaugccggugacccacuccagcgccgcccagcgccgggggcgcaucggccggaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgcgagaagguggacgcgaucgacggcgaguaccggcuccgcggggaggcccgcaagaccuucgucgaccugaugcggcgcggcgaccugcccguguggcucgccuacaagguggccgccgaggggaucaacuacgcggaccggcgcuggugcuucgacggcaucaagaacaaccagauccuggaggagaacgucgagguggagaucuggacgaaggagggggagcggaagaagcugaagccgcgcuggcucgacgcccggaucuacagcgacccccuggcccugaaggaguucaaggaguucgccgccggccgcaagucccucacccugaaccugaucaccgagaugggccggcuccccaccuucaugacgcagaagacccgcgacgcgcuggacaaccuggccguccuccacaccgccgaggccgggggccgggcguacaaccacgcccugagcgagcugcccgagacccucgagacgcugcugcuccugacccugcucgccaccgugaccgggggcaucuuccuguuccugauguccggccgcgggaucggcaagaugacccucgggaugugcugcaucaucacggccagcauccugcugugguacgcccagauccagccgcacuggaucgcggccuccaucauccucgaguucuuccugaucgugcugcucauccccgagcccgagaagcagcggacgccccaggacaaccagcugaccuacgucgugaucgccauccugaccguggucgccgccacgauggcgaacgagaugggcuuccucgagaagaccaagaaggaccuggggcugggcagcaucgccacccagcagccggaguccaacauccucgacaucgaccugcgccccgccagcgccuggacccuguacgccguggcgacgaccuucgugacccccaugcuccggcacuccaucgagaacagcagcgucaacgugucccugaccgccaucgccaaccaggccacggugcugaugggccucgggaagggcuggccccugagcaagauggacaucggggucccgcugcucgccaucggcugcuacucccaggugaaccccaucacccugaccgcggcccugcuccugcugguggcccacuacgccaucaucgggcccggccuccaggcgaaggccacccgcgaggcccagaagcgggccgccgcgggcaucaugaagaaccccacggucgacgggaucaccgugaucgaccuggacccgauccccuacgaccccaaguucgagaagcagcugggccaggugaugcuccugauccugugcgucacccaggugcucaugaugcgcaccacgugggcccugugcgaggcccugacccucgccaccgggcccaucagcacccugugggagggcaacccggggcgguucuggaacacgaccaucgccguguccauggcgaacaucuuccgcggcagcuaccuggccggcgccgggcuccuguucuccaucaugaagaacaccaccaacacgcggcgcggcaccgggaacaucggcgagacccugggcgagaaguggaagucccgccucaacgcccugggcaagagcgaguuccagaucuacaagaaguccgggauccaggaggucgaccggacccuggccaaggaggggaucaagcgcggcgagacggaccaccacgcggugucccgggggagcgccaagcuccgcugguucguggagcggaacauggucacccccgagggcaaggugguggaccugggcugcgggcgcggcgggugguccuacuacugcggcgggcugaagaacguccgggaggugaagggccucaccaagggcgggcccggccacgaggagcccaucccgaugagcaccuacggguggaaccuggugcgccugcaguccggcgucgacguguucuucaucccgcccgagaagugcgacacgcuccugugcgacaucggggagagcucccccaacccgaccguggaggccggccggacccugcgcguccucaaccugguggagaacuggcugaacaacaacacccaguucugcaucaaggugcugaaccccuacaugcccagcgucaucgagaagauggaggcccuccagcggaaguacggcggggcgcuggugcgcaacccgcugucccggaacagcacccacgagauguacugggugagcaacgccuccggcaacaucgucagcuccgugaacaugaucagccgcaugcucaucaaccgguucacgaugcgccacaagaaggccaccuacgagcccgacguggaccugggguccggcacccggaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcggcuccugaccaagccgugggacguccugcccacggugacccagauggcgaugaccgacaccacgcccuucgggcagcagcgcguguucaaggagaaggucgacacccgcacccaggagcccaaggagggcaccaagaagcucaugaagaucacggccgaguggcuguggaaggagcugggcaagaagaagaccccgcggaugugcacccgcgaggaguucacccggaaggugcgcagcaacgccgcccucggggccaucuucacggacgagaacaaguggaaguccgcgcgggaggccguggaggacagccgcuucugggagcuggucgacaaggagcggaaccugcaccucgagggcaagugcgagaccugcguguacaacaugauggggaagcgcgagaagaagcugggcgaguucgggaaggccaagggcucccgggccaucugguacauguggcugggcgcccgcuuccucgaguucgaggcgcugggguuccugaacgaggaccacugguucagccgggagaacucccucagcggcgucgagggggagggccugcacaagcugggguacauccuccgcgacguguccaagaaggagggcggcgccauguacgccgacgacaccgccgggugggacacccggaucacgcuggaggaccugaagaacgaggagauggugaccaaccacauggagggcgagcacaagaagcucgcggaggccaucuucaagcugaccuaccagaacaaggucgugcgcgugcagcggcccacgccccgcgggaccgucauggacaucaucagccggcgcgaccagcggggcagcggccaggugggcaccuacggccugaacaccuucaccaacauggaggcccagcucauccgccagauggagggggagggcguguucaagaacauccagcaccugacggucaccgaggagguggccgugcagaacuggcuggcccgggucgggcgcgagcgccucucccggauggcgaucagcggcgacgacugcguggugaagccccuggacgaccgcuucgccaacgcccugaccgcccucaacgacaugggcaagauccggaaggacauccagcagugggagccguccaagggguggaacgacuggacccagguccccuucugcagccaccacuuccacgagcugaucaugaaggacggccgcgugcuggugguccccugccggaaccaggacgagcucaucgggcgcgcccggaucucccagggcgcgggguggagccugcgcgagacggccugccugggcaaguccuacgcccagauguggagccucauguacuuccaccggcgcgaccugcggcuggccgccaacgcgaucugcuccgccgugcccagccacugggugccgaccucccgcaccaccuggagcauccacgccaagcacgaguggaugaccacggaggacaugcucaccgucuggaaccggguguggauccgcgagaaccccuggauggaggacaagacccccguggaguccugggaggagauccccuaccugggcaagcgggaggaccaguggugcgggagccugaucggccucaccucccgcgccacgugggccaagaacauccaggcggccaucaaccagguccggagccugaucgggaacgaggaguacaccgacuacaugccguccaugaagcgcuuccggcgcgaggaggaggaggccggcgugcugugguga

SEQ ID NO: 9499 - RNA, 9876 nt, Artificial Sequence
  derived and/or modified CDS sequence (opt1) from DENV-2__EU482446__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacacggggcacgagugggucaccgacuucaagggcaagaccgugugguucgugccguccaucaaggccgggaacgacaucgcggccugccugcggaagaacggcaagaaggucauccagcugagccgcaagaccuucgacuccgaguacgugaagacgcggaccaacgacugggacuucguggucaccaccgacaucagcgagaugggcgccaacuucaaggccgagcgcgugaucgacccccggcgcugcaugaagcccgugauccucacggacggggaggagcgggucauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccguccugcacaccgccgaggccgggggccgggcguacaaccacgcccucagcgagcugcccgagacccuggagacgcuccugcugcucacccugcuggccaccgugaccgggggcaucuuccucuuccugauguccggccgcgggaucggcaagaugacccuggggaugugcugcaucaucacggccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucgggcugggcagcaucgccacccagcagccggaguccaacauccuggacaucgaccuccgccccgccagcgccuggacccuguacgccguggcgacgaccuucgugacccccaugcugcggcacuccaucgagaacagcagcgucaacgugucccucaccgccaucgccaaccaggccacggugcugaugggccuggggaagggcuggccccucagcaagauggacaucggggucccgcugcuggccaucggcugcuacucccaggugaaccccaucacccucaccgcggcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggccaccgggcccaucagcacccucugggagggcaacccggggcgguucuggaacacgaccaucgccguguccauggcgaacaucuuccgcggcagcuaccuggccggcgccgggcuccucuucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgcggugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacgcugcucugcgacaucggggagagcucccccaacccgaccguggaggccggccggacccugcgcguccugaaccucguggagaacuggcugaacaacaacacccaguucugcaucaaggugcugaaccccuacaugcccagcgucaucgagaagauggaggcccugcagcggaaguacggcggggcgcucgugcgcaacccgcugucccggaacagcacccacgagauguacugggugagcaacgccuccggcaacaucgucagcuccgugaacaugaucagccgcaugcugaucaaccgguucacgaugcgccacaagaaggccaccuacgagcccgacguggaccucggguccggcacccggaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcggcugcucaccaagccgugggacguccugcccacggugacccagauggcgaugaccgacaccacgcccuucgggcagcagcgcguguucaaggagaaggucgacacccgcacccaggagcccaaggagggcaccaagaagcugaugaagaucacggccgaguggcucuggaaggagcugggcaagaagaagaccccgcggaugugcacccgcgaggaguucacccggaaggugcgcagcaacgccgcccugggggccaucuucacggacgagaacaaguggaaguccgcgcgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcgucgagggggagggccuccacaagcugggguacauccugcgcgacguguccaagaaggagggcggcgccauguacgccgacgacaccgccgggugggacacccggaucacgcucgaggaccugaagaacgaggagauggugaccaaccacauggagggcgagcacaagaagcuggcggaggccaucuucaagcucaccuaccagaacaaggucgugcgcgugcagcggcccacgccccgggggacggucauggacaucaucagccggcgcgaccagcggggcagcggccagguggggaccuacggccugaacaccuucaccaacauggaggcccagcugauccgccagauggagggggagggcguguucaagaacauccagcaccucacggucaccgaggagguggccgugcagaacuggcuggcccgggucgggcgcgagcgccugucccggauggcgaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcccggaucucccagggcgcgggguggagccuccgcgagacggccugccugggcaaguccuacgcccagauguggagccugauguacuuccaccggcgcgaccuccggcuggccgccaacgcgaucugcuccgccgugcccagccacugggugccgaccucccgcaccaccuggagcauccacgccaagcacgaguggaugaccacggaggacaugcugaccgucuggaaccggguguggauccgcgagaaccccuggauggaggacaagacccccguggaguccugggaggagauccccuaccucggcaagcgggaggaccaguggugcgggagccugaucggccugaccucccgcgccacgugggccaagaacauccaggcggccaucaaccagguccggagccucaucgggaacgaggaguacaccgacuacaugccguccaugaagcgcuuccggcgcgaggaggaggaggccggcgugcugugguga
